US011905563B2

(12) United States Patent
Rigoutsos et al.

(10) Patent No.: US 11,905,563 B2
(45) Date of Patent: Feb. 20, 2024

(54) LEVERAGING THE PRESENCE OR ABSENCE OF MIRNA ISOFORMS FOR RECOMMENDING THERAPY IN CANCER PATIENTS

(71) Applicant: THOMAS JEFFERSON UNIVERSITY, Philadelphia, PA (US)

(72) Inventors: Isidore Rigoutsos, Philadelphia, PA (US); Aristeidis G. Telonis, Philadelphia, PA (US)

(73) Assignee: Thomas Jefferson University, Philadelphia, PA (US)

( * ) Notice: Subject to any disclaimer, the term of this patent is extended or adjusted under 35 U.S.C. 154(b) by 879 days.

(21) Appl. No.: 16/343,256

(22) PCT Filed: Oct. 23, 2017

(86) PCT No.: PCT/US2017/057909
§ 371 (c)(1),
(2) Date: Apr. 18, 2019

(87) PCT Pub. No.: WO2018/076015
PCT Pub. Date: Apr. 26, 2018

(65) Prior Publication Data
US 2019/0249262 A1 Aug. 15, 2019

Related U.S. Application Data

(60) Provisional application No. 62/502,133, filed on May 5, 2017, provisional application No. 62/441,837, filed on Jan. 3, 2017, provisional application No. 62/411,417, filed on Oct. 21, 2016.

(51) Int. Cl.
| | |
|---|---|
| *C12Q 1/6886* | (2018.01) |
| *G01N 1/30* | (2006.01) |
| *G01N 33/50* | (2006.01) |
| *G16B 40/00* | (2019.01) |
| *G16B 40/20* | (2019.01) |
| *G16B 40/30* | (2019.01) |
| *G16H 50/30* | (2018.01) |
| *G16H 50/20* | (2018.01) |
| *G16B 25/00* | (2019.01) |
| *G16B 25/10* | (2019.01) |
| *G16H 50/70* | (2018.01) |

(52) U.S. Cl.
CPC .......... *C12Q 1/6886* (2013.01); *G01N 1/30* (2013.01); *G01N 33/50* (2013.01); *G16B 40/00* (2019.02); *G16B 40/20* (2019.02); *G16B 40/30* (2019.02); *G16H 50/20* (2018.01); *G16H 50/30* (2018.01); *C12Q 2600/106* (2013.01); *C12Q 2600/112* (2013.01); *C12Q 2600/118* (2013.01); *C12Q 2600/156* (2013.01); *C12Q 2600/158* (2013.01); *C12Q 2600/178* (2013.01); *G16B 25/00* (2019.02); *G16B 25/10* (2019.02); *G16H 50/70* (2018.01)

(58) Field of Classification Search
CPC ........ G16H 50/30; G16H 50/20; G16B 40/00; G16B 40/30; G16B 40/20; G01N 1/30; G01N 33/50; C12Q 1/6886
See application file for complete search history.

(56) References Cited

FOREIGN PATENT DOCUMENTS

| WO | 2014179765 A2 | 11/2014 | | |
|---|---|---|---|---|
| WO | WO-2014179765 A2 | * | 11/2014 | ........... C12Q 1/6886 |

OTHER PUBLICATIONS

Li et al. BMC Genomics 2012 13(suppl 1): S13 (Year: 2012).*
Aalto, A.P., et al., "Small non-coding RNAs mount a silent revolution in gene expression", Current Opinion in Cell Biology, vol. 24, No. 3, pp. 333-340, 2012.
Backes, C., et al., "miRPathDB: a new dictionary on microRNAs and target pathways", Nucleic Acids Research, vol. 45, pp. D90-D96, 2016.
Bandiera, S., et al., "miR-122-a key factor and therapeutic target in liver disease", Journal of Hepatology, vol. 62, pp. 448-457, 2015.
Barroso-Del Jesus, A., et al., "The miR-302-367 cluster as a potential sternness regulator in ESCs", Cell Cycle, No. 8, No. 3, pp. 394-398, 2009.
Bartel, D.P., "MicroRNAs: genomics, biogenesis, mechanism, and function", Cell, vol. 116, pp. 281-297, 2004.
Bartel, D.P., "MicroRNAs: target recognition and regulatory functions", Cell, vol. 136, pp. 215-233, 2009.
Boele, J., et al., "PAPD5-mediated 3' adenylation and subsequent degradation of miR-21 is disrupted in proliferative disease", Proceedings of the National Academy of Sciences of the USA, vol. 111, No. 31, pp. 11467-11472, 2014.
Calin, G.A., et al., "MicroRNA signatures in human cancers", Nature Reviews Cancer, vol. 6, pp. 857-866, 2006.
Cancer Genome Atlas Network, "Comprehensive molecular characterization of human colon and rectal cancer", Nature, vol. 487, No. 7407, pp. 330-337, 2012.
Chu, A., "Large-scale profiling of microRNAs for The Cancer Genome Atlas", Nucleic Acids Research, vol. 44, No. 1, e3, 2016.
Clark, M.B., et al., "The dark matter rises: the expanding world of regulatory RNAs", Essays in Biochemistry, vol. 54, pp. 1-16, 2013.
Clerget, G., et al., "Small non-coding RNAs: a quick look in the rearview mirror", Methods in Molecular Biology, vol. 1296, pp. 3-9, 2015.

(Continued)

*Primary Examiner* — Jerry Lin
(74) *Attorney, Agent, or Firm* — Cozen O'Connor

(57) ABSTRACT

A method of identifying a subject in need of therapeutic intervention to treat a disease or condi-tion or disease recurrence or disease progression comprising, isolating isomiRs or miRNAs from a sample obtained from the subject; and characterizing the isomiRs or miRNAs and their presence or absence in the sample to identify a signature, wherein when the signature is indicative of a di-agnosis of the disease then treatment of the subject is recommended.

62 Claims, 23 Drawing Sheets
Specification includes a Sequence Listing.

(56) References Cited

OTHER PUBLICATIONS

Coolen, M., et al., "miR-9: a versatile regulator of neurogenesis", Frontiers in Cellular Neuroscience, vol. 7, No. 220, pp. 1-11, 2013.
Cortez, M.A., et al., "MicroRNAs in body fluids-the mix of hormones and biomarkers", Nature Reviews Clinical Oncology, vol. 8, No. 8, pp. 467-477, 2011.
Di Leva, G., et al., "MicroRNAs in cancer", Annual Review of Pathology, vol. 9, pp. 287-314, 2014.
Dumortier, O., et al., "Shaping and preserving beta-cell identity with microRNAs" Diabetes, Obesity & Metabolism, vol. 18, Suppl 1, pp. 51-57, 2016.
Edelstein, L.C., et al., "MicroRNAs in platelet production and activation", Journal of Thrombosis and Haemo-stasis: JTH, vol. 11, Suppl 1, pp. 340-350, 2013.
Flowers, et al., "MicroRNAs associated with exercise and diet: a systematic review", Physiological Genomics, vol. 47, pp. 1-11, 2015.
Gao, Z., et al., "The miR-302/367 cluster: a comprehensive update on its evolution and functions", Open Biology, vol. 5, No. 150138, 7 pages, 2015.
Goswami, R., et al., "Optimization and analysis of a quantitative real-time PCR-based technique to determine microRNA expression in formalin-fixed paraffin-embedded samples", BMC Biotechnology, vol. 10, No. 47, pp. 1-12, 2010.
Guyon, I., et al., "Gene Selection for Cancer Classification using Support Vector Machines", Machine Learning, vol. 46, Issue 1-3, pp. 389-422, 2002.
Ha, M., et al., "Regulation of microRNA biogenesis", Nature Reviews Molecular Cell Biology, vol. 15, pp. 509-524, 2014.
Hilz, A., et al., "The roles of microRNAs and siRNAs in mammalian spermatogenesis", Development, vol. 143, No. 17, pp. 3061-3073, 2016.
Honda, S., et al., "Dumbbell-PCR: a method to quantify specific small RNA variants with a single nucleotide resolution at terminal sequences", Nucleic Acids Research, vol. 43, No. 12, e77, 12 pages, 2015.
Hood, L., et al., "The Human Genome Project: big science transforms biology and medicine", Genome Medicine, vol. 5, No. 79, 8 pages, 2013.
Hornick, N.I., et al., "Serum Exosome MicroRNA as a Minimally-Invasive Early Biomarker of AML", Scientific reports, vol. 5, No. 11295, 11 pages, 2015.
Judish, L.I., et al., "miR-219 regulates neural progenitors by dampening apical Par protein-dependent Hedgehog signaling", Development, vol. 143, pp. 2292-2304, 2016.
Jeon, T.I., et al., "miRNA and cholesterol homeostasis", Biochimica et Biophysica Acta, vol. 1861, No. 12 Pt B, pp. 2041-2046, 2016.
Koppers-Lalic, D., et al., "Nontemplated nucleotide additions distinguish the small RNA composition in cells from exosomes", Cell Reports, vol. 8, pp. 1649-1658, 2014.
Koppers-Lalic, D., et al., "Non-invasive prostate cancer detection by measuring miRNA variants (isomiRs) in urine extracellular vesicles", Oncotarget, vol. 7, No. 16, pp. 22566-22578, 2016.
Kumar, P., et al., "miR-ID: a novel, circularization-based platform for detection of microRNAs", RNA, vol. 17, pp. 365-380, 2011.
Landgraf, P., et al., "A mammalian microRNA expression atlas based on small RNA library sequencing", Cell, vol. 129, pp. 1401-1414, 2007.
Lee, et al., "The C. elegans heterochronic gene lin-4 encodes small RNAs with antisense complementarity to lin-14", Cell, vol. 75, No. 5, pp. 843-854, 1993.
Loher, P., et al., "IsomiR Expression Profiles in Human Lymphoblastoid Cell Lines Exhibit Population and Gender Dependencies", Oncotarget, vol. 5, No. 18, pp. 8790-8802, 2014.
Londin, E., et al., "Analysis of 13 cell types reveals evidence for the expression of numerous novel primate- and tissue-specific microRNAs", Proceedings of the National Academy of Sciences of the USA, vol. 112, No. 10, pp. E1106-E1115, 2015.
Lu, J., et al., "MicroRNA expression profiles classify human cancers", Nature, vol. 435, No. 7043, pp. 834-838, 2005.

McCall, M.N., et al., "The Gene Expression Barcode 3.0: improved data processing and mining tools", Nucleic Acids Research, vol. 42, pp. D938-D943, 2014.
McHardy, A.C., et al., "Accurate phylogenetic classification of variable-length DNA fragments", Nature Methods, vol. 4, No. 1, pp. 63-72, 2007.
Mehta, R., et al., "Circulating miRNA in patients with non-alcoholic fatty liver disease and coronary artery disease", BMJ Open Gastroenterology, vol. 3, No. e000096, 7 pages, 2016.
Mogilyansky, E., et al., "The miR-17/92 cluster: a comprehensive update on its genomics, genetics, functions and Increasingly important and numerous roles in health and disease", Cell Death and Differentiation, vol. 20, pp. 1603-1614, 2013.
Noble, W.S., "What is a support vector machine?", Nature Biotechnology, vol. 24, No. 12, pp. 1565-1567, 2006.
Pimental, F., et al., "Technology in MicroRNA Profiling: Circulating MicroRNAs as Noninvasive Cancer Biomarkers in Breast Cancer", Journal of Laboratory Automation, vol. 20, No. 5, pp. 574-588, 2014.
Reinhart, B.J., et al., "The 21-nucleotide let-7 RNA regulates developmental timing in Caenorhabditis elegans", Nature, vol. 403, 901-906, 2000.
Rosenfeld, N., et al., "MicroRNAs accurately identify cancer tissue origin", Nature Biotechnology, vol. 26, No. 4, pp. 462-469, 2008.
Salem, O., et al., "The highly expressed 5'isomiR of hsa-miR-140-3p contributes to the tumor-suppressive effects of miR-140 by reducing breast cancer proliferation and migration", BMC Genomics, vol. 17, No. 566, 16 pages, 2016.
Schaefer, M.H., et al., "Cell type-specific properties and environment shape tissue specificity of cancer genes", Scientific Reports, vol. 6, No. 20707, 14 pages, 2016.
Schirle, N.T., et al., "Structural basis for microRNA targeting", Science, vol. 346, No. 6209, pp. 608-613, 2014.
Shi, J. "Considering Exosomal miR-21 as a Biomarker for Cancer", Journal of Clinical Medicine, vol. 5, No. 42, 12 pages, 2016.
Shmulevich, I., et al., "Binary analysis and optimization-based normalization of gene expression data", Bioinformatics, vol. 18, No. 4, pp. 555-565, 2002.
Sparks, E., et al., "Spatiotemporal signalling in plant development", Nature Reviews Genetics, vol. 14, No. 9, pp. 631-644, 2013.
Starega-Roslan, J., et al., "Sequence features of Drosha and Dicer cleavage sites affect the complexity of isomiRs," International Journal of Molecular Sciences, vol. 16, pp. 8110-8127, 2015.
Statnikov, A., et al., "A comprehensive comparison of random forests and support vector machines for microarray-based cancer classification", BMC Bioinformatics, vol. 9, No. 319, 10 pages, 2008.
Su, K., et al., "Diagnostic and prognostic value of plasma microRNA-195 in patients with non-small cell lung cancer", World Journal of Surgical Oncology, vol. 14, No. 224, 6 pages, 2016.
Tan, G.C, Chan, E., Molnar, A., Sarkar, R., Alexieva, D., Isa, I.M., Robinson, S., Zhang, S., Ellis, P., Langford, C.F. et al. (2014) 5' isomiR variation is of functional and evolutionary importance. Nucleic acids research, 42, pp. 9424-9435, 2014.
Telonis, A.G., et al., "Beyond the one-locus-one-miRNA paradigm: microRNA isoforms enable deeper insights into breast cancer heterogeneity", Nucleic Acids Research, vol. 43, No. 19, pp. 9158-9175, 2015.
Telonis, A.G., et al., "Knowledge about the presence or absence of miRNAisoforms (isomiRs) can successfully discriminate amongst 32 TCGA cancer types", Nucleic Acids Research, vol. 45, No. 6, pp. 2973-2985, 2017.
Tsirigos, A., et al., "A sensitive, support-vector-machine method for the detection of horizontal gene transfers in viral, archaeal and bacterial genomes", Nucleic Acids Research, vol. 33, No. 12, pp. 3699-3707, 2005.
Tuna, S., et al., "Classification with binary gene expressions". Journal of Biomedical Science and Engineering, vol. 2, No. 6, pp. 390-399, 2009.
Veneziano, D., et al., "Noncoding RNA: Current Deep Sequencing Data Analysis Approaches and Challenges", Human Mutation, vol. 37, No. 12, pp. 1283-1298, 2016.

(56) References Cited

OTHER PUBLICATIONS

Volnia, S., et al., "A microRNA expression signature of human solid tumors defines cancer gene targets", Proceedings of the National Academy of Sciences of the USA, vol. 103, No. 7, pp. 2257-2261, 2006.

Volloch, V., et al., "Antisense globin RNA in mouse erythroid tissues: Structure, origin, and possible function", Proceedings of the National Academy of Sciences of the USA, vol. 93, pp. 2476-2841, 1996.

Wang, Y., et al., "Identification of miRNAs as potential new biomarkers for nervous system cancer", Tumour biology: The Journal of the International Society for Oncodevelopmental Biology and Medicine, vol. 35, No. 11, pp. 11631-1163, 2014.

Warnecke, F., et al., "Metagenomic and functional analysis of hindgut microbiota of a wood-feeding higher termite", Nature, vol. 450, No. 7169, pp. 560-565, 2007.

Winter, J., et al., "Many roads to maturity: microRNA biogenesis pathways and their regulation", Nature Cell Biology, vol. 11, No. 3, pp. 228-234, 2009.

Wojcicka, A., et al., "Next generation sequencing reveals microRNA isoforms in liver cirrhosis and hepatocellular carcinoma", The International Journal of Biochemistry & Cell Biology, vol. 53, pp. 208-217, 2014.

Xin, H., et al., "Blood-based multiple-microRNA assay displays a better diagnostic performance than single-microRNA assay in the diagnosis of breast tumor", Tumour Biology: The Journal of the International Society for Oncodevelopmental Biology and Medicine, vol. 35, No. 12, pp. 12635-12643, 2014.

Yang, Z.R., "Biological applications of support vector machines", Briefings in Bioinformatics, vol. 5, No. 4, pp. 328-338, 2004.

Yuva-Aydemir, Y., et al., "MicroRNA-9: functional evolution of a conserved small regulatory RNA", RNA Biology, vol. 8, No. 4, pp. 557-564, 2011.

Zilliox, M.J., et al., "A gene expression barcode for microarray data", Nature Methods, vol. 4, No. 11, pp. 911-913, 2007.

International Search Report dated Jan. 4, 2018 in International Application No. PCT/US2017/057909.

* cited by examiner

FIG. 7

| Cancer: | AC TGCT | THYM | READ AD | KIHC | THCA | COAD | LUAD | LUSC | HNSC | CESC | UCEC | UCS | PAAD | LGG | STAD | PCPG | UVM | SKCM | BLCA | BRCA | MESO | LIHC | PRAD | DLBC | KIRC | CHOL | ESCA | KIRP | OV | SARC | LAML | Sample # |
|---|---|---|---|---|---|---|---|---|---|---|---|---|---|---|---|---|---|---|---|---|---|---|---|---|---|---|---|---|---|---|---|---|
| miR-202-5p\|0\|-1-1 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 195 |
| miR-202-5-\|0\|-2 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 137 |
| miR-202-5p\|0\|0 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 132 |
| miR-202-5p\|-1/-1 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 114 |
| miR-202-5p\|0\|+1 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 106 |
| miR-202-3p\|-1\|0 | 0 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 1 | 0 | 1 | 1 | 1 | 1 | 211 |
| miR-202-5p\|0\|-3 | 0 | 1 | 1 | 1 | 1 | 1 | 1 | 1 | 1 | 1 | 1 | 1 | 1 | 1 | 1 | 0 | 1 | 1 | 1 | 1 | 1 | 1 | 1 | 1 | 1 | 1 | 1 | 1 | 1 | 1 | 1 | 92 |
| miR-202-3p\|0\|+1 | 0 | 1 | 1 | 1 | 1 | 1 | 1 | 1 | 1 | 1 | 1 | 1 | 1 | 1 | 1 | 0 | 1 | 1 | 1 | 1 | 1 | 1 | 1 | 1 | 1 | 1 | 0 | 1 | 1 | 1 | 1 | 247 |
| mir-202\|10\|-\|135061041\|135062 | 0 | 1 | 1 | 1 | 1 | 1 | 1 | 1 | 1 | 1 | 1 | 1 | 1 | 1 | 1 | 0 | 1 | 1 | 1 | 1 | 1 | 1 | 1 | 1 | 1 | 1 | 0 | 1 | 1 | 1 | 1 | 179 |
| miR-509-3p\|0\|-1 | 0 | 0 | 1 | 1 | 1 | 1 | 1 | 1 | 1 | 1 | 1 | 1 | 1 | 1 | 1 | 1 | 1 | 0 | 1 | 1 | 1 | 1 | 1 | 1 | 1 | 1 | 0 | 1 | 1 | 1 | 1 | 597 |
| miR-508-5p\|0\|0 | 0 | 1 | 1 | 1 | 1 | 1 | 1 | 1 | 1 | 1 | 1 | 1 | 1 | 1 | 1 | 1 | 0 | 1 | 0 | 1 | 1 | 1 | 1 | 1 | 1 | 1 | 0 | 1 | 1 | 1 | 1 | 601 |
| miR-503-5p\|0\|-1 | 0 | 1 | 1 | 1 | 1 | 1 | 1 | 1 | 1 | 1 | 1 | 1 | 1 | 1 | 1 | 1 | 0 | 1 | 0 | 1 | 1 | 1 | 1 | 0 | 1 | 1 | 1 | 1 | 0 | 1 | 1 | 591 |
| miR-509-3p\|0\|-2 | 0 | 1 | 1 | 1 | 1 | 0 | 0 | 1 | 1 | 1 | 1 | 1 | 1 | 1 | 1 | 0 | 1 | 1 | 0 | 1 | 1 | 1 | 1 | 1 | 1 | 1 | 0 | 1 | 1 | 1 | 1 | 526 |
| miR-508-3p\|0\|-2 | 0 | 0 | 1 | 1 | 1 | 0 | 1 | 1 | 1 | 1 | 1 | 1 | 1 | 1 | 1 | 0 | 0 | 1 | 0 | 1 | 1 | 1 | 1 | 1 | 1 | 1 | 0 | 1 | 1 | 1 | 1 | 470 |
| miR-509-3p\|0\|+1 | 0 | 0 | 1 | 1 | 1 | 1 | 1 | 1 | 1 | 1 | 1 | 1 | 1 | 1 | 1 | 0 | 1 | 1 | 0 | 1 | 1 | 1 | 1 | 1 | 1 | 1 | 0 | 1 | 1 | 1 | 1 | 1129 |
| miR-509-3p\|+2\|+1 | 0 | 1 | 1 | 1 | 1 | 1 | 0 | 1 | 1 | 0 | 0 | 1 | 1 | 1 | 1 | 0 | 0 | 1 | 0 | 1 | 1 | 1 | 1 | 1 | 1 | 1 | 0 | 1 | 1 | 1 | 1 | 518 |
| miR-483-5p\|0\|+1 | 1 | 1 | 0 | 1 | 1 | 1 | 1 | 1 | 1 | 1 | 0 | 0 | 1 | 1 | 1 | 0 | 0 | 0 | 0 | 1 | 0 | 0 | 1 | 1 | 1 | 1 | 1 | 1 | 0 | 0 | 1 | 581 |
| miR-514a-3p\|-2\|-1 | 0 | 0 | 1 | 1 | 0 | 1 | 1 | 1 | 1 | 1 | 1 | 1 | 1 | 1 | 1 | 0 | 1 | 1 | 0 | 1 | 1 | 1 | 1 | 1 | 1 | 0 | 0 | 1 | 1 | 1 | 1 | 591 |
| miR-508-3p\|+2\|0 | 0 | 0 | 1 | 1 | 0 | 0 | 1 | 0 | 1 | 1 | 0 | 0 | 1 | 1 | 1 | 0 | 0 | 1 | 0 | 1 | 1 | 1 | 1 | 1 | 1 | 1 | 0 | 1 | 1 | 1 | 1 | 1039 |
| miR-514a-3p\|-3\|-1 | 0 | 0 | 1 | 1 | 1 | 0 | 0 | 0 | 0 | 1 | 1 | 1 | 1 | 1 | 1 | 0 | 1 | 1 | 0 | 1 | 1 | 1 | 1 | 1 | 1 | 0 | 0 | 1 | 1 | 1 | 1 | 363 |
| miR-509-3p\|0\|0 | 0 | 0 | 1 | 1 | 1 | 0 | 1 | 0 | 1 | 1 | 0 | 0 | 1 | 1 | 1 | 0 | 0 | 1 | 0 | 1 | 1 | 1 | 1 | 1 | 1 | 1 | 0 | 1 | 1 | 1 | 1 | 1450 |
| miR-514a-3p\|0\|0 | 0 | 0 | 1 | 1 | 0 | 0 | 1 | 0 | 1 | 1 | 1 | 1 | 1 | 1 | 1 | 0 | 0 | 1 | 0 | 1 | 1 | 1 | 1 | 1 | 1 | 1 | 0 | 0 | 1 | 1 | 1 | 1084 |
| miR-10b-5p\|-1\|-1 | 0 | 1 | 1 | 1 | 1 | 0 | 1 | 1 | 1 | 1 | 0 | 0 | 1 | 0 | 1 | 0 | 0 | 0 | 1 | 0 | 1 | 1 | 1 | 1 | 0 | 1 | 1 | 0 | 1 | 0 | 1 | 1906 |
| miR-514a-3p\|-3\|0 | 0 | 1 | 1 | 0 | 1 | 1 | 1 | 0 | 0 | 1 | 1 | 1 | 1 | 1 | 1 | 0 | 0 | 0 | 0 | 1 | 0 | 1 | 1 | 1 | 1 | 1 | 1 | 1 | 1 | 0 | 1 | 280 |
| miR-514a-3p\|-2\|0 | 0 | 0 | 1 | 1 | 0 | 1 | 0 | 1 | 0 | 1 | 1 | 1 | 1 | 1 | 1 | 1 | 0 | 0 | 1 | 0 | 1 | 1 | 1 | 1 | 1 | 1 | 0 | 0 | 1 | 1 | 1 | 1521 |
| miR-483-5p\|0\|0 | 0 | 1 | 0 | 1 | 1 | 1 | 0 | 1 | 1 | 1 | 0 | 0 | 1 | 1 | 1 | 0 | 1 | 0 | 0 | 1 | 0 | 0 | 1 | 1 | 1 | 0 | 1 | 1 | 0 | 0 | 1 | 1011 |
| miR-483-5p\|+1\|+3 | 1 | 1 | 0 | 0 | 1 | 0 | 1 | 1 | 1 | 1 | 0 | 0 | 1 | 1 | 0 | 0 | 0 | 1 | 0 | 0 | 0 | 1 | 1 | 1 | 1 | 0 | 1 | 0 | 0 | 0 | 1 | 489 |
| miR-483-5p\|0\|-1 | 0 | 1 | 0 | 0 | 1 | 1 | 1 | 1 | 1 | 1 | 0 | 0 | 1 | 1 | 0 | 0 | 0 | 1 | 0 | 0 | 1 | 1 | 1 | 1 | 1 | 1 | 1 | 0 | 0 | 1 | 1 | 893 |
| miR-483-3p\|0\|+1 | 0 | 1 | 0 | 0 | 1 | 0 | 0 | 1 | 1 | 1 | 0 | 0 | 1 | 0 | 0 | 1 | 1 | 0 | 0 | 1 | 1 | 1 | 1 | 1 | 1 | 1 | 1 | 0 | 0 | 1 | 1 | 630 |

FIG. 7 cont.

| Row | Value |
|---|---|
| miR-483-3p\|+1\|+2 | 1143 |
| miR-508-3p\|0\|-3 | 504 |
| let-7e-5p\|0\|+2 | 1433 |
| miR-508-3p\|0\|-1 | 2210 |
| miR-508-3p\|0\|0 | 2720 |
| miR-542-3p\|-1\|0 | 2745 |
| miR-10b-3p\|0\|0 | 2878 |
| TJU_CMC_MD2.ID02736.5p-miR\|0\|0 | 3060 |
| miR-99b-3p\|0\|+1 | 2887 |
| miR-125a-5p\|0\|-4 | 2851 |
| let-7e-5p\|0\|-4 | 2220 |
| miR-503-5p\|0\|0 | 3407 |
| let-7e-5p\|0\|-4 | 2089 |
| miR-450a-5p\|0\|0 | 1969 |
| miR-10b-5p\|0\|-5 | 4517 |
| miR-328-3p\|0\|-1 | 3252 |
| miR-127-5p\|0\|+1 | 4260 |
| miR-542-3p\|-1\|-1 | 5015 |
| miR-1180-3p\|0\|0 | 5999 |
| miR-10b-5p\|+1\|-3 | 5677 |
| miR-1468-5p\|0\|+1 | 2960 |
| let-7f-5p\|0\|-3 | 6335 |
| miR-127-5p\|0\|0 | 7473 |
| miR-542-3p\|0\|+1 | 6079 |
| miR-450b-5p\|0\|-1 | 5206 |
| miR-181a-2-3p\|-1\|-1 | 4632 |
| miR-181b-5p\|0\|+2 | 3 |
| miR-766-3p\|0\|0 | 2524 |

FIG. 8

LEVERAGING THE PRESENCE OR ABSENCE OF MIRNA ISOFORMS FOR RECOMMENDING THERAPY IN CANCER PATIENTS

CROSS REFERENCE TO RELATED APPLICATIONS

This application claims priority to International Patent Application No. PCT/US2017/57909, filed Oct. 23, 2017, published on Apr. 26, 23018 as Publication No. WO 2018/076015, which claims priority to U.S. Provisional Patent Application No. 62/411,417, filed Oct. 21, 2016, U.S. Provisional Patent Application No. 62/441,837, filed Jan. 3, 2017, and U.S. Provisional Patent Application No. 62/502,133, filed May 5, 2017, each of which are hereby incorporated by reference in their entirety.

SEQUENCE LISTING

The instant application contains a Sequence Listing which has been filed electronically in ASCII format and is hereby incorporated by reference in its entirety. Said ASCII copy, created on Oct. 23, 2017, is named 6107-164PCT_SL.txt and is 1,261,782 bytes in size.

BACKGROUND OF INVENTION

In the post-genomic era, the flourishing of microarray and next-generation sequencing (NGS) technologies has made the generation of large amount of data a quick and relatively inexpensive process. As a result, the challenge nowadays is how to best manipulate and analyze big volumes of information. This has led to the development of novel tools, or the adaptation of previously-developed algorithms for use in the biological and medical fields (1).

During this time, the field of non-coding RNAs (ncRNAs) enjoyed very significant progress. In fact, RNA-sequencing technologies helped uncovered many novel categories of short and long RNA transcripts (2). In the process, they also revealed multiple layers of regulatory processes.

Among ncRNAs, microRNAs (miRNAs) are arguably the best-studied to date (3-5). The details of miRNA biogenesis (6-8) and function (7,9,10) were worked out more than a decade ago. Parallel studies linked miRNAs to a wide range of cellular, molecular and physiological processes in development (11-15), and homeostasis (16-18). In addition, miRNAs play important roles in physiological conditions and diseases (19-21), including cancer (22,23).

Their potent regulatory roles, small size, and relatively easy quantification have made miRNAs ideal targets as potential biomarkers (24-26). They also inspired research on their use as tumor classifiers. i.e. as features/variables used to construct statistical models to classify and/or predict the type of a given tumor. E.g., Lu et al. used hierarchical clustering to classify miRNA profiles of tumor samples into groups of cancer types (27). Subsequent work by Volinia et al. (28) and by Rosenfeld et al. (29) further demonstrated the power of the miRNA profile to classify tumors and predict cancer types.

More than two decades since their discovery, the mining of RNA-seq datasets continues to generate important observations about miRNAs. Perhaps most important is the ever-increasing repertoire of miRNAs, which has implications for the complexity of the miRNA regulatory layer. This was recently demonstrated by the discovery of numerous primate-specific miRNAs with tissue-dependent expression patterns (30). This complexity increased further with the recent discovery that miRNA isoforms (isomiRs) are constitutive, and their expression depends on sex, population, race, tissue type, tissue state, and disease subtype (31-34).

Several lines of evidence, both computational and experimental, support the functional importance of isomiRs. Intuitively, this is not surprising considering that isomiR profiles provide a richer and more granular representation of the molecules produced from each miRNA locus compared to the single molecule, the "archetype," that one finds listed in public databases. As we exemplified in the case of breast cancer, isomiRs are better in capturing breast cancer heterogeneity than the archetype miRNA (35). Recently, others and we also showed that distinct isomiRs originating from the same miRNA arm can target multiple distinct genes and molecular pathways (31,34,35).

The Cancer Genome Atlas (TCGA) initiative has been successfully integrating miRNA profiles with messenger RNA (mRNA) expression and genome-wide sequence information to further explain disease subtypes. More than 11,000 samples from more than two dozen cancer types have been profiled today at the levels of miRNA, mRNA, protein, epigenome, etc. Specifically for miRNAs and isomiRs, tools were developed to analyze TCGA's RNA-seq datasets and have generated what is a unique and rich resource for this kind of research (36).

SUMMARY OF INVENTION

Our recent analyses of expression profiles from hundreds of individuals showed that "how many" and "which" isomiRs are produced from a given miRNA locus depends on the locus and the tissue, among other variables (31, 35). This is in agreement with previous reports of miRNAs that are specifically expressed in some tissues but absent from other (30, 37). These findings suggest that miRNA expression signatures are complex and dynamic. They also support the notion of using miRNAs as biomarkers. An ideal miRNA-based biomarker should be specific to the cancer that it is used to diagnose and should not be present in other tissues or cancer types. This characteristic prompted us to investigate the usability of miRNAs and isomiRs as markers: they should be uniquely expressed (present) in the cancer under study and absent in all other cancers.

Here we describe our findings from a pan-cancer analysis of TCGA's short RNA-seq datasets. Specifically, we evaluated the ability of "binarized" expression profiles, or "binarized profiles" for short, (see below for a definition) that we built on isomiRs or the arms of miRNAs to discriminate among the 32 TCGA cancer types. For protein-coding transcripts, binarized profiles were shown previously to exhibit robustness to noise and to contain enough information to distinguish among tumor types (38, 39) and among tissues (40). A binarized profile can be thought of as a collection of features, each of which can assume one of two possible values. Typically, these values are 0 and 1. 0 indicates 'absence' of a feature whereas 1 indicates 'presence.' For isomiRs, we generated "binarized isomiR profiles" as follows: after thresholding in an adaptive manner, we ignored the isomiR's actual level of abundance and instead declared it present, if its expression exceeds threshold; otherwise, we declared it absent. We also evaluated the ability of "binarized miRNA-arm profiles" to discriminate among the 32 TCGA cancer types. In this case, we declared the 5p of the miRNA arm present, if at least one of its isomiRs is present above threshold, and absent otherwise. Analogously, we declared the 3p of the miRNA arm present, if at least one of its isomiRs is present above threshold, and absent otherwise. Recall that the typical miRNA precursor resembles a 'hairpin.' The hairpin arm that we encounter first when traversing the hairpin in the direction of transcription is referred to as the 'left' or 5p arm; the other arm is referred to as the 'right' or 3p arm. Clearly, the miRNA-arm representation greatly reduces the information that the analysis is allowed to use. The inventions described herein include a method of identifying a subject in need of therapeutic intervention to treat one or more of: adrenocortical carcinoma (ACC), bladder urothelial carcinoma (BLCA), breast invasive carcinoma (BRCA), cervical squamous cell carcinoma and endocervical adenocarcinoma (CESC), cholangiocarcinoma (CHOL), colon adenocarcinoma (COAD), lymphoid neoplasm diffuse large B-cell lymphoma (DLBC), esophageal carcinoma (ESCA), head and neck squamous cell carcinoma (HNSC), kidney chromophobe (KICH), kidney renal clear cell carcinoma (KIRC), kidney renal papillary cell carcinoma (KIRP), acute myeloid leukemia (LAML), brain lower grade glioma (LGG), liver hepatocellular carcinoma (LIHC), lung adenocarcinoma (LUAD), lung squamous cell carcinoma (LUSC), mesothelioma (MESO), ovarian serous cystadenocarcinoma (OV), pancreatic adenocarcinoma (PAAD), pheochromocytoma and paraganglioma (PCPG), prostate adenocarcinoma (PRAD), rectum adenocarcinoma (READ), sarcoma (SARC), skin cutaneous melanoma (SKCM), stomach adenocarcinoma (STAD), testicular germ cell tumors (TGCT), thyroid carcinoma (THCA), thymoma (THYM), uterine corpus endometrial carcinoma (UCEC), uterine carcinosarcoma (UCS), uveal melanoma (UVM), or, progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM or, recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM comprising, isolating miRNAs from a sample obtained from the subject; and characterizing the presence or absence in the sample of either the isomiRs or of the arms of the miRNA precursors to identify a signature, wherein when the signature is indicative of a diagnosis of the disease then treatment of the subject is recommended.

In preferred embodiments, the sample is isolated from one or more cells, tissue or body fluid obtained from the subject. Preferentially, when the sample is a body fluid, it is selected from the group consisting of amniotic fluid, aqueous humour and vitreous humour, bile, blood serum, breast milk, cerebrospinal fluid, cerumen, chyle, chyme, endolymph and perilymph, exudates, feces, female ejaculate, gastric acid, gastric juice, lymph, mucus, pericardial fluid, peritoneal fluid, pleural fluid, pus, rheum, saliva, sebum, serous fluid, semen, smegma, sputum, synovial fluid, sweat, tears, urine, vaginal secretion, and vomit.

By contrast, a sample can also be selected from the group consisting of one or more peripheral blood cells, one or more tumor cells, a one or more circulating tumor cells, or a one or more exosomes.

When performing the method as described above, the miRNAs or isomiRs are isolated by a method selected from the group consisting of size selection, sequencing, and amplification. Preferably the miRNAs or isomiRs with a length in the range of about 15 nucleotides to about 25 nucleotides are isolated.

In certain embodiments, the signature is obtained through deep sequencing, or the signature is obtained by hybridization to a panel of oligonucleotides, or the signature is obtained through a quantification method that is specific to the termini of the sought molecule (or molecules).

Certain embodiments allow the method as described above, wherein the actual abundance of the isolated miRNAs is not taken into account by subsequent analyses.

A further embodiment is directed to a method of identifying a subject in need of therapeutic intervention to treat one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM or, progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM: a classifier that has been trained using as positive examples samples from one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, and as negative examples disease-free samples or samples from non-cancer diseases or samples from cancers other than ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM wherein said classifier uses features that are based on knowledge of the presence or absence of expression of one or more isomiRs of interest or of one or both arms of one or more miRNA precursors of interest; focusing on isomiRs or on miRNAs from a sample obtained from the subject; characterizing the presence or absence of expression of one or more isomiRs of interest or of one or both arms of one or more miRNA precursors of interest in the sample to identify a signature for the sample; using the classifier to evaluate the signature of the sample; and, recommending treatment of the subject if the signature of the sample is indicative of a diagnosis of the disease. Negative examples can include samples from ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM as long as samples from a given cancer type are not simultaneously given as positive and negative examples to a classifier aimed at distinguishing among cancer types. Negative examples can include samples from ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM as long as samples from a given cancer sub-type are not simultaneously given as positive and negative examples to a classifier aimed at distinguishing among cancer sub-types.

Preferably, the sample is isolated from one or more cells, from tissue, or from body fluid obtained from the subject. In certain embodiments, the body fluid is selected from the group consisting of amniotic fluid, aqueous humour and vitreous humour, bile, blood serum, breast milk, cerebrospinal fluid, cerumen, chyle, chyme, endolymph and perilymph, exudates, feces, female ejaculate, gastric acid, gastric juice, lymph, mucus, pericardial fluid, peritoneal fluid, pleural fluid, pus, rheum, saliva, sebum, serous fluid, semen, smegma, sputum, synovial fluid, sweat, tears, urine, vaginal secretion, and vomit. In other embodiments, the sample is selected from the group consisting of one or more peripheral blood cells, one or more tumor cells, one or more circulating tumor cells, or one or more exosome.

In certain methods, the selection of isomiRs or miRNAs is through a method selected from the group consisting of size selection, sequencing, and amplification. For example, the method where isomiRs or miRNAs with a length in the range of about 15 nucleotides to about 25 nucleotides are isolated.

In certain embodiments, a method may derive or acquire the signature through deep sequencing, or by hybridization to a panel of oligonucleotides, or through use of one or more qRT-PCR assays, or of related variants. For example, a method may derive or acquire the signature through a quantification method that is specific to the termini of the sought molecule (or molecules).

In certain embodiments, the actual abundance of the miRNAs is not considered by subsequent analyses. In other embodiments, only the presence or absence of the miRNAs is considered by subsequent analyses. In other embodiments, an arm of a miRNA precursor is considered present if at least one of the distinct molecules that the arm could produce is present, or wherein an arm of a miRNA precursor is considered absent if none of the distinct molecules that the arm could produce is present.

In the embodiments, a suitable step further comprises administration of a suitable therapeutic for treatment of the disease.

In certain embodiments, the positive examples include only samples from one of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM. In other embodiments, the positive examples included samples from at least two of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM.

In a preferred embodiment, a method for identifying a subject in need of therapeutic intervention to treat one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM may utilize a classifier that has been trained using as features at least 7,466 isomiRs, or a classifier that has been trained using as features at least 2,588 isomiRs, or a classifier that has been trained using as features at least 1,883 isomiRs, or a classifier that has been trained using as features at least 1,147 isomiRs, or a classifier that has been trained using as features at least 456 isomiRs, or a classifier that has been trained using as features at least 172 isomiRs.

In a preferred embodiment, the 7,466 isomiRs include one or more of the sequences with identifiers SEQ ID NO: 1 through SEQ ID NO:7,466 inclusive.

In a preferred embodiment, the 2,588 isomiRs include one or more of the sequences with identifiers SEQ ID NO: 1 through SEQ ID NO: 2,588 inclusive.

In a preferred embodiment, the 1,883 isomiRs include one or more of the sequences with identifiers SEQ ID NO: 1 through SEQ ID NO: 1,883 inclusive.

In a preferred embodiment, the 1,147 isomiRs include one or more of the sequences with identifiers SEQ ID NO: 1 through SEQ ID NO: 1,147 inclusive.

In a preferred embodiment, the 456 isomiRs include one or more of the sequences with identifiers SEQ ID NO: 1 through SEQ ID NO: 456 inclusive.

These embodiments preferably provide a method, wherein the average sensitivity can be as high as 90% and wherein the average false detection rate can be less than 3%.

The methods for identifying a subject in need of therapeutic intervention to treat one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAR, TGCT, THCA, THYM, UCEC, UCS, UVM, or identifying recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM may advantageously employ a classifier that has been trained using as features at least 456 isomiRs, or at least 1,147 isomiRs, or at least 1,883 isomiRs, or at least 2,588 isomiRs, or at least 7,466 isomiRs.

The methods for identifying a subject in need of therapeutic intervention to treat one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAR, TGCT, THCA, THYM, UCEC, UCS, UVM, or identifying progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAR, TGCT, THCA, THYM, UCEC, UCS, UVM, or identifying recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAR, TGCT, THCA, THYM, UCEC, UCS, UVM may advantageously utilize a classifier that has been trained using as features at least 807 arms of miRNA precursors, or a classifier that has been trained using as features at least 285 arms of miRNA precursors, or a classifier that has been trained using as features at least 198 arms of miRNA precursors, or a classifier that has been trained using as features at least 115 arms of miRNA precursors, or a classifier that has been trained using at least 47 arms of miRNA precursors, or a classifier that has been trained using at least 21 arms of miRNA precursors.

In a preferred embodiment, the 807 arms of miRNA precursors include one or more of the sequences with identifiers SEQ ID NO: 7,467 through SEQ ID NO: 8,273 inclusive.

In a preferred embodiment, the 285 arms of miRNA precursors include one or more of the sequences with identifiers SEQ ID NO: 7,467 through SEQ ID NO: 7,751 inclusive.

In a preferred embodiment, the 198 arms of miRNA precursors include one or more of the sequences with identifiers SEQ ID NO: 7,467 through SEQ ID NO: 7,664 inclusive.

In a preferred embodiment, the 115 arms of miRNA precursors include one or more of the sequences with identifiers SEQ ID NO: 7,467 through SEQ ID NO: 7,581 inclusive.

In a preferred embodiment, the 47 arms of miRNA precursors include one or more of the sequences with identifiers SEQ ID NO: 7,467 through SEQ ID NO: 7,513 inclusive.

These embodiments preferably provide a method, wherein the average sensitivity can be as high as 83% and wherein the average false detection rate can be less than 6%.

The methods for identifying a subject in need of therapeutic intervention to treat one or more of ACC, BLCA, BRCA, CESC, CHOL, COAD, DLBC, ESCA, HNSC, KICH, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM may advantageously employ a classifier that has been trained using as features at least 47 arms of miRNA precursors, or at least 115 arms of miRNA precursors, or at least 198 arms of miRNA precursors, or at least 285 arms of miRNA precursors, or at least 807 arms of miRNA precursors.

The methods for identifying a subject in need of therapeutic intervention to treat STAD, or identifying progression of STAD, or identifying recurrence of STAD may utilize a classifier that has been trained using as features at least 161 arms of miRNA precursors, or a classifier that has been trained using as features at least 80 arms of miRNA precursors, or a classifier that has been trained using as features at least 40 arms of miRNA precursors, or a classifier that has been trained using as features at least 24 arms of miRNA precursors, or a classifier that has been trained using as features at least 16 arms of miRNA precursors.

In a preferred embodiment, the 161 arms of miRNA precursors include one or more of the sequences with identifiers SEQ ID NO: 8,274 through SEQ ID NO: 8,434 inclusive.

In a preferred embodiment, the 80 arms of miRNA precursors include one or more of the sequences with identifiers SEQ ID NO: 8,274 through SEQ ID NO: 8,353 inclusive.

In a preferred embodiment, the 40 arms of miRNA precursors include one or more of the sequences with identifiers SEQ ID NO: 8,274 through SEQ ID NO: 8,313 inclusive.

In a preferred embodiment, the 24 arms of miRNA precursors include one or more of the sequences with identifiers SEQ ID NO: 8,274 through SEQ ID NO: 8,297 inclusive.

In a preferred embodiment, the 16 arms of miRNA precursors include one or more of the sequences with identifiers SEQ ID NO: 8,274 through SEQ ID NO: 8,289 inclusive.

These embodiments preferably provide a method, wherein the average sensitivity can be as high as 69% and wherein the average false detection rate can be less than 18%.

The methods for identifying a subject in need of therapeutic intervention to treat STAD, or identifying progression of STAD, or identifying recurrence of STAD may advantageously employ a classifier that has been trained using as features at least 16 arms of miRNA precursors, or at least 24 arms of miRNA precursors, or at least 40 arms of miRNA precursors, or at least 80 arms of miRNA precursors, or at least 161 arms of miRNA precursors.

The methods for identifying a subject in need of therapeutic intervention to treat one or more of STAD, COAD, READ, ESCA, PAAD, or identifying progression of one or more of STAD, COAD, READ, ESCA, PAAD, or identifying recurrence of one or more of STAD, COAD, READ, ESCA, PAAD may utilize a classifier that has been trained using as features at least 161 arms of miRNA precursors, or a classifier that has been trained using as features at least 80 arms of miRNA precursors, or a classifier that has been trained using as features at least 40 arms of miRNA precursors, or a classifier that has been trained using as features at least 24 arms of miRNA precursors, or a classifier that has been trained using as features at least 16 arms of miRNA precursors.

For example, the 161 arms of miRNA precursors include one or more of the sequences with identifiers SEQ ID NO: 8,435 through SEQ ID NO: 8,595 inclusive.

In a preferred embodiment, the 80 arms of miRNA precursors include one or more of the sequences with identifiers SEQ ID NO: 8,435 through SEQ ID NO: 8,514 inclusive.

In a preferred embodiment, the 40 arms of miRNA precursors include one or more of the sequences with identifiers SEQ ID NO: 8,435 through SEQ ID NO: 8,474 inclusive.

In a preferred embodiment, the 24 arms of miRNA precursors include one or more of the sequences with identifiers SEQ ID NO: 8,435 through SEQ ID NO: 8,458 inclusive.

In a preferred embodiment, the 16 arms of miRNA precursors include one or more of the sequences with identifiers SEQ ID NO: 8,435 through SEQ ID NO: 8,450 inclusive.

These embodiments preferably provide a method, wherein the average sensitivity can be as high as 93% and wherein the average false detection rate can be less than 5%.

A further embodiment is directed to a method of identifying a subject in need of therapeutic intervention to treat one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying progression of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM, or identifying recurrence of one or more of ACC, BLCA, BRCA, CESC, CHOL, COAD, DLBC, ESCA, HNSC, KICH, KIRC, KIRP, LAML, LGG, LIHC, LUAD, LUSC, MESO, OV, PAAD, PCPG, PRAD, READ, SARC, SKCM, STAD, TGCT, THCA, THYM, UCEC, UCS, UVM; comprising, isolating isomiRs or isolating miRNAs from a sample obtained from the subject; and characterizing the isomiRs or the arms of miRNA precursors and their presence or absence in the sample to identify a signature, wherein when the signature is indicative of a diagnosis of the disease then treatment of the subject is recommended.

A method of identifying a subject in need of therapeutic intervention to treat a disease or condition or disease recurrence or disease progression comprising, isolating isomiRs or miRNAs from a sample obtained from the subject; and characterizing the isomiRs or miRNAs and their presence or absence in the sample to identify a signature, wherein when the signature is indicative of a diagnosis of the disease then treatment of the subject is recommended.

A method of treating a subject in need of therapeutic intervention to treat a disease or condition or disease recurrence or disease progression comprising, isolating isomiRs or miRNAs from a sample obtained from the subject; characterizing the isomiRs or miRNAs and their presence or absence in the sample to identify a signature, wherein the characterization of the isomiRs or miRNAs is selected from sequences SEQ ID NO: 1 through SEQ ID NO:7,466, or SEQ ID NO: 7,467 through SEQ ID NO: 8,273; wherein when the signature is indicative of a diagnosis of a disease; treating said subject with a therapeutic corresponding to the disease.

Any of the above embodiments may be combined in whole or part with one another, as appropriate and understood by those of ordinary skill in the art.

BRIEF DESCRIPTION OF THE DRAWINGS

FIG. 7 illustrates differentially present isomiRs among cancers. Shown is a partial such list for one cancer (ACC). The full list of tables is provided in Application No. 62/411,417. In the shown list, a positive (+1) value indicates that the isomiR is present in ACC (see title above the table) and absent in the cancer shown in the header of the respective column. A negative (−1) value indicates the opposite. A value of '0' indicates no differential presence between ACC and the cancer shown in the header of the respective column.

Figure 8:
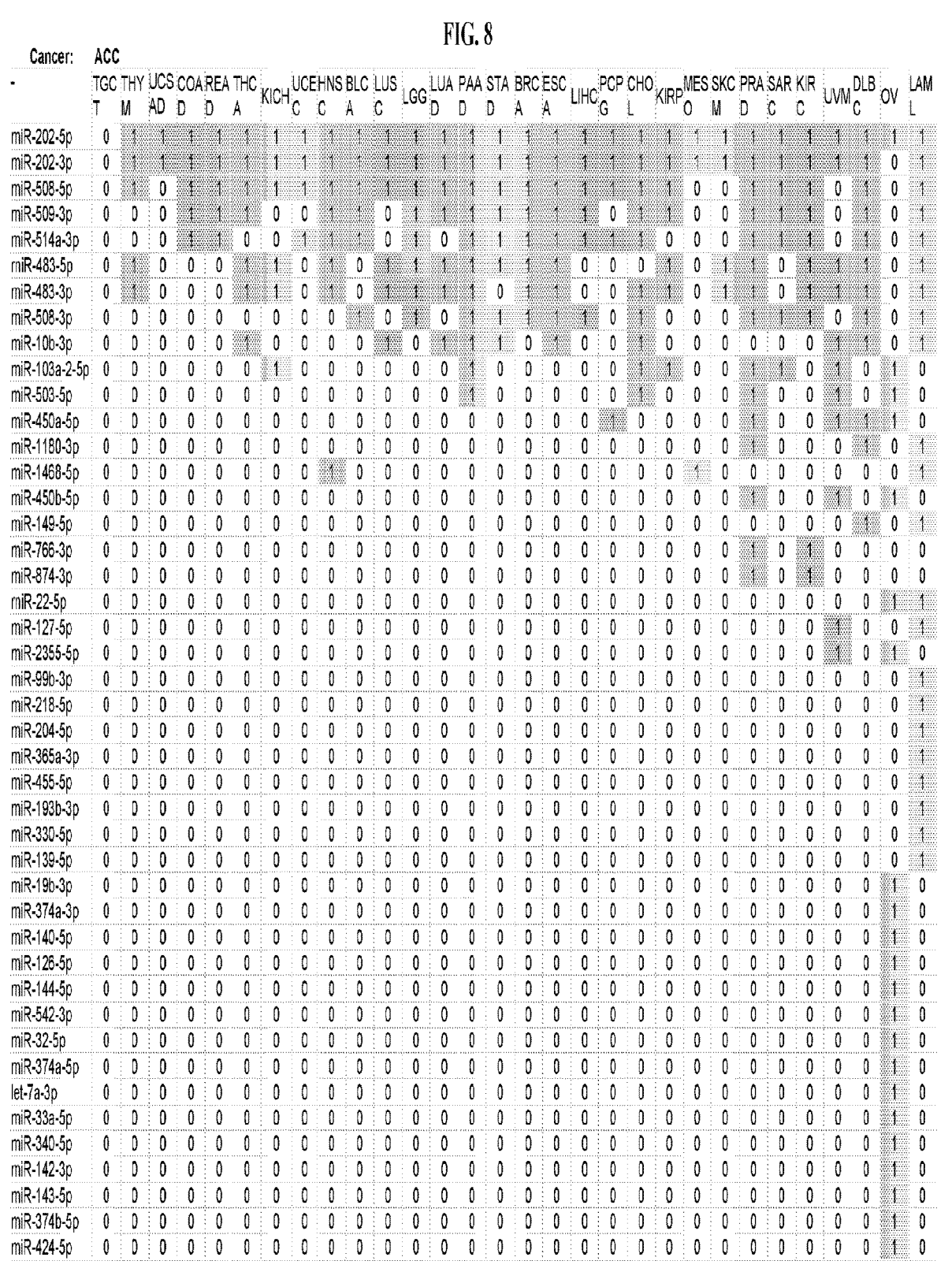

FIG. 8 illustrates differentially present miRNA arms among cancers. Shown is a partial such list for one cancer (ACC). The full list of tables is provided in Application No. 62/411,417. In the shown list, a positive (+1) value indicates that the miRNA arm is present in ACC (see title above the table) and absent in the cancer shown in the header of the respective column. A negative (−1) value indicates the opposite. A value of '0' indicates no differential presence between ACC and the cancer shown in the header of the respective column.

DETAILED DESCRIPTION OF THE EMBODIMENTS

Materials and Methods

Data Acquisition and Correction

Figure 1A:
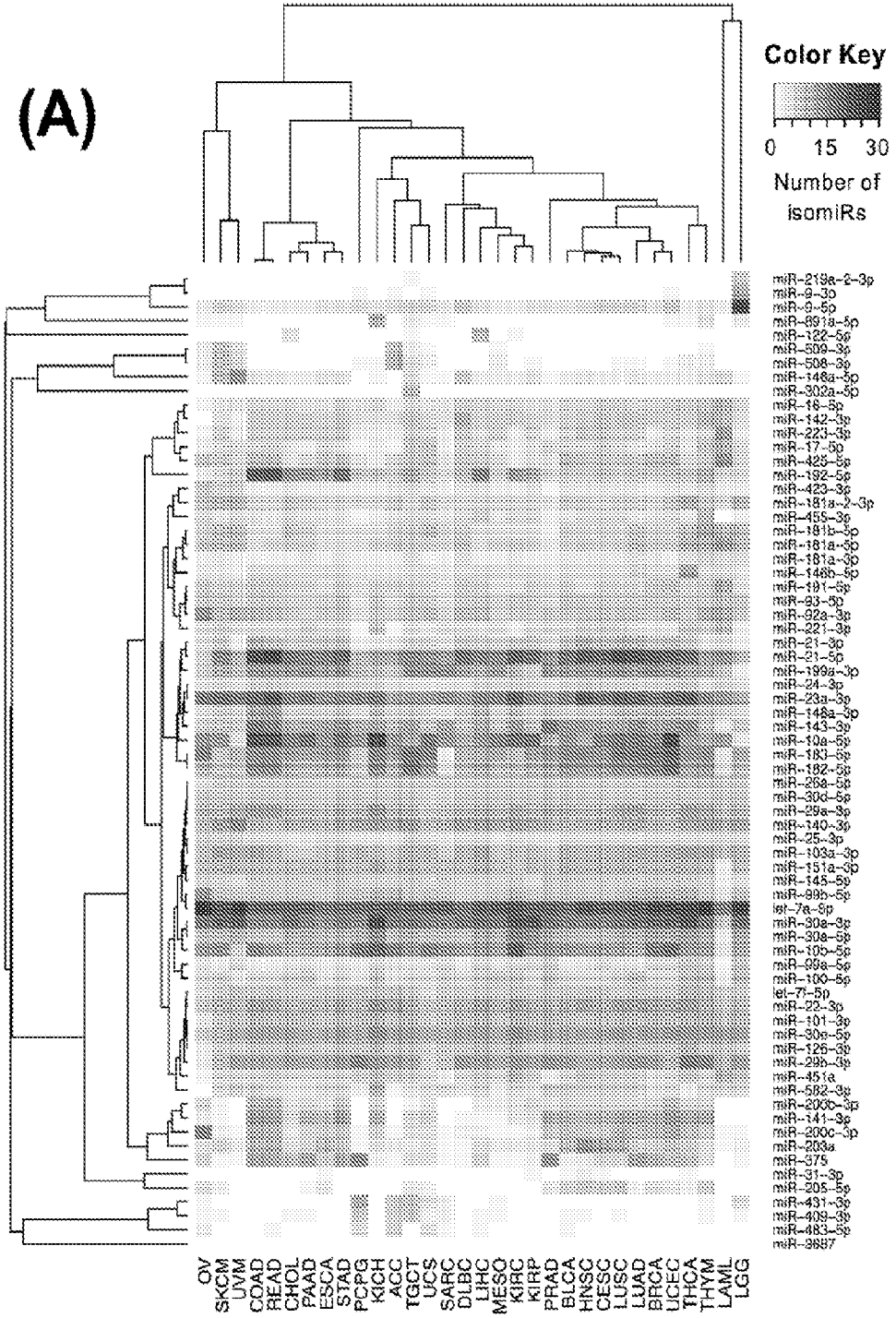
FIGS. 1A-1D illustrate differentially present isomiRs among different cancer types. (A) Heatmap of the number of isomiRs per miRNA arm. The darker the color of each cell, the higher the number of isomiRs that the respective arm (rows of the heatmap) produces in the respective cancer type (columns of the heatmap). (B) Differential presence of isomiRs in lower grade glioma (LGG) tumor samples as compared to the rest of cancer types. Dark gray indicates that the isomiR (row) was found as 'present' in LGG as compared to the respective cancer type (column), while light gray indicates 'absence' in LGG. The data for all possible pairwise comparisons are included in Application No. 62/411,417. (C) Overlap between miRNA arms and isomiRs in the comparison of colon adenocarcinoma (COAD) with the rest of the cancer types. Dark gray indicates that both the isomiR and the arm were 'present' in COAD as compared to at least one other cancer type, light gray indicates they were 'absent'. For example, miR-205-5p was 'absent' in COAD as well as its five isomiRs, miR-205-5p|0|0, miR-205-5p|0|-3, miR-205-5p|0|-2, miR-205-5p|0|-1 and miR-205-5p|0|+1. (D) Hierarchical clustering (complete method) considering the number of differentially present isomiRs as the distance between cancer types.

We quantified the TCGA isomiR expression data of 10,271 samples at the molecule/isomiR-sequence level. In order to do this, we took the publicly downloadable loci-based isoform.quantification.txt files from the TCGA datasets (downloaded from the TCGA data portal https://tcga-data.nci.nih.gov on Aug. 6, 2015) and converted them to be molecule/sequence based. We corrected for (a) the observation that if a mature sequence could come from multiple loci, loci-based expression assignment was arbitrarily, (b) the fact that the isoform.quantification.txt files often included only a subset of possible loci for ambiguously transcribed miRNA loci and (c) including our previously reported novel miRNAs (30) to the isomiR expression files if they came from one of the mapped hairpins. Importantly, while we looked at expression level at the molecule level, we still recorded all possible loci from which an isomiR may have been transcribed.

For our analyses, we used all TCGA samples from 32 cancer types. We excluded from our analyses all samples that were specifically annotated (file_annotations.txt files of the Clinical Data from the TCGA data portal, downloaded on 28 Oct. 2015), resulting in 9,745 samples. We further filtered non-tumor samples, e.g. normal adjacent tissue or metastastic samples, including only samples that had a sample infix of '01' or '03' in the TCGA barcode name.

Binarized IsomiR and miRNA Arm Profiles

We worked on a per-sample basis in order to generate the binarized isomiR profiles. Specifically, for each sample independently we considered the top 20% most expressed isomiRs as 'present'. As we described above, to generate the binarized miRNA arm profiles, we collapsed the information at the arm level: if there was at least one isomiR (originating from the respective arm) that was characterized as 'present', then the arm was also marked as 'present'. There are cases where an isomiR could be mapped exactly to more than one miRNA arms. In such instances, we merged all the miRNA arms that shared an isomiR into "meta-arms." There are several dozen meta-arms that arise in our analyses. We discuss this again below.

Statistical and Machine Learning Analyses

Analyses were done in R and python. Specifically, hamming distance was calculated with the hamming distance function of the e1071 package, while all other distance metrics of hierarchical clustering (HCL) were performed with the cluster function of the amap package. Visualization of dendrograms was performed with the dendextend package of R. $X^2$ tests were performed and P values were corrected to FDR values. Significance in the $x^2$ test was further filtered so that the absolute difference between the percentage (%) of samples containing the isomiR or miRNA arm in one cancer but not the other had to be greater than or equal to 80%. Networks were visualized using the igraph package in R SVMs were run with the svm function of the e1071 package in R with linear kernel function and with allowed probability predictions. After the SVM model was trained, the probability vectors (one per sample) were computed for each sample in the test set. Each vector has 32 elements each one representing the probability that the given sample is of the respective cancer type. The sample is classified to the cancer type with the highest probability unless this probability is lower than 0.5. In this case, we classify the sample in the 'Other' category. Sensitivity and FDR scores were estimated per cancer per iteration. Sensitivity was defined as the number of true positive classifications divided by the total number of samples, while FDR was calculated as the number of false positive samples divided by the number of samples identified as cancer, i.e. non-Other. The VI scores were computed per isomiR or miRNA arm as the average of the square values of the weights across all pairwise SVM comparisons and then were scaled to 1 by dividing by the maximum score. RandomForest was run with the H2O package in R.

PubMed entries were found per miRNA gene. The unique gene identifiers in the Gene database of NCBI were retrieved and the number of links to PubMed entries was counted (as of Oct. 7, 2016).

Results

Preliminary Material and Definition

We analyzed the isomiR expression profiles for 10,271 samples from 32 cancer types. To deal with miRNAs with multiple genomic copies (paralogues), we worked at the level of the sequenced reads: thusly, for isomiRs whose sequences exist at more than one genomic locus we kept one representative instance avoiding multiple counting. Consequently, we represented each sample using an expression vector with as many dimensions as the number of distinct isomiR sequences that are expressed in the sample.

Figure 6:
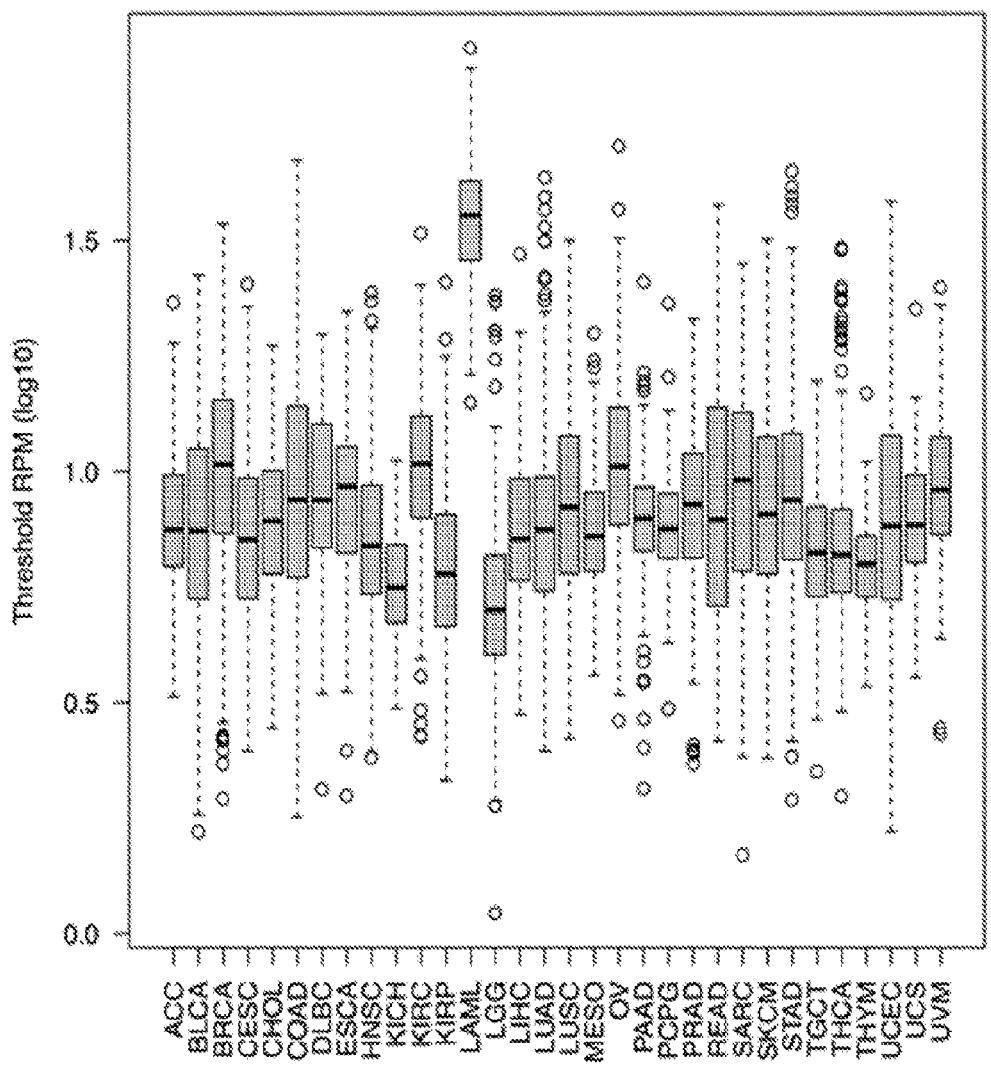
FIG. 6 illustrates the quantization threshold per sample per cancer type. The mean threshold for all samples included in our study was 9.7 RPM.

As mentioned already, we intentionally focus on binarized isomiR profiles, i.e. profiles that simply list an isomiR as present or absent. We determined an isomiR's presence or absence independently for each sample and without any influences by the isomiR's genomic origin. Binarization of isomiR abundances proceeded as follows: within the sample at hand, we considered as "present" the top 20% most abundant isomiRs; all other isomiRs were labeled "absent." In the case of the TCGA datasets, drawing the line at the top 20%, represented an average threshold of ~10 reads per million (RPM), i.e. 10 RPM, which is a stringent threshold (FIG. 6).

In addition to working with the binarized profiles of isomiRs, we also explored an alternative scheme, namely "miRNA-arm binarization." This representation scheme collapses the information captured by multiple isomiRs into a single statement of "present" or "absent." As already stated, if a miRNA arm, either 5p or 3p, has at least one of its isomiRs labeled "present," then this arm is labeled as "present," otherwise it is labeled "absent."

Statistics of Binarized IsomiRs

By processing the 10,271 TCGA samples, we accumulated a total of 7,466 isomiRs that passed threshold in at least one sample. These isomiRs arise from 807 arms that correspond to 515 known miRNA genes and 40 miRNA genes among the newly discovered miRNAs that were reported by Londin et al. (30). As provided in Application No. 62/411,417, Supp. Tables S1 and S2 list the binarized expression profiles for isomiRs and miRNA arms, respectively. Such data is incorporated by reference in its entirety. Our analyses were carried out on the samples corresponding to primary solid tumors (sample infix '01' in the TCGA sample barcode) except for LAML where blood-derived samples were used (sample infix '03'), including a total of 9,291 datasets (tumor samples) and 7,271 isomiRs.

By analyzing the 7,271 isomiRs that occupy the 20% most abundant positions in at least one sample, we found that the vast majority of them (90.2%) are present in fewer than half of the analyzed tumor samples. Only 48 out of the 7,271 isomiRs are present in all datasets. Interestingly, 11 of the 48 isomiRs arise from loci that belong to the let-7 family of miRNAs. Other isomiRs that are present in many of the analyzed datasets arise from widely-studied miRNA loci including miR-21, miR-29, miR-30, the miR-17/92 cluster and its paralogues. For individual miRNA loci, the distribution of their isomiRs varied greatly across samples. For example, let-7 isomiRs were "dichotomized:" one subset is present in most of the TCGA datasets whereas a second subset is present in fewer than 25% of the datasets.

A significant portion (58.8%) of the 7,271 isomiRs is present in fewer than 100 samples each. Moreover, 77.5% of the 7,271 isomiRs are present in at least two of the 32 distinct cancer types. These findings suggest that the expression of many of the identified isomiRs has a cancer-specific dimension.

FIG. 1A depicts as a heatmap the variation in the number of isomiRs from a given locus. Only the top 70 loci from the standpoint of the isomiRs they produce are shown in the heatmap. As can be seen let-7a-5p consistently produces numerous isomiRs independent of cancer type. MiR-21-5p and miR-30a-3p also produce many isomiRs in many of the 32 analyzed cancers. OV in the case of miR-21-5p, and LAML in the case of miR-30a-3p are notable exceptions to this observation. Analogously, we also observed several miRNA arms that produce numerous isomiRs in some cancers only. The 5p and 3p arms of miR-9 are a characteristic such example: both arms produce numerous isomiRs in LGG.

Figure 1B:
Figure 1C:
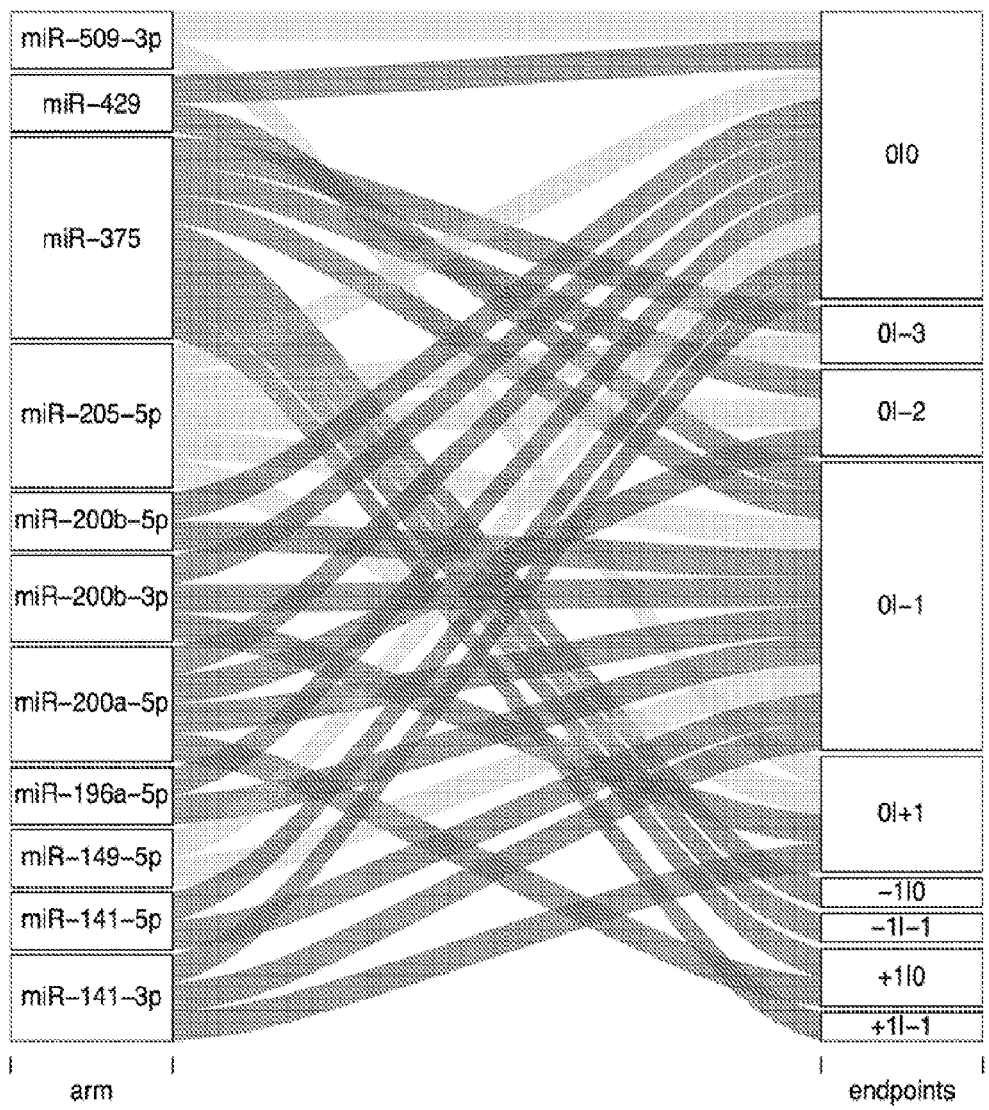

The Binarized IsomiR Profiles Reveal Cancer-Dependent Production of Abundant IsomiRs We studied systematically the binarized differences of presence/absence of abundant isomiRs among cancers by conducting all possible pairwise comparisons among 32 cancers. For each comparison, we performed $x^2$ tests, suitable for comparison of binarized data, for all isomiRs in the two given cancers. To focus on the most discriminatory isomiRs, we imposed a False Discovery Rate (FDR) threshold of 0.1% and further required that the percentage of samples in each cancer that contain the isomiR differ by at least 80%. We were able to identify several isomiRs that were significantly present in one cancer and absent from many of the remaining ones (FIG. 7). FIG. 1B illustrates this observation using LGG as an example. As already mentioned above (FIG. 1A), isomiRs from the miR-9-3p arm are present in LGG samples and absent from nearly all other cancers. The opposite holds true for isomiRs from the miR-10a-5p arm and the miR-200 family: they are absent from LGG and present in 71-93% of the other cancers. Another characteristic example can be seen in FIG. 1A: in TGCT, there is significant presence of many isomiRs from the miR-302 family that are absent from nearly all other cancers.

MiRNA-Arm Transcription is Also Cancer-Dependent

Noticing the co-presence/co-absence of isomiRs from the same miRNA arm in some cancers, we tested the hypothesis that the miRNA arms themselves are also differentially present among cancer types. We repeated the previous $X^2$ analysis for the binarized profiles of miRNA arms (see above for definitions) and were able to largely replicate the results that we obtained at the isomiR level. COAD provides a characteristic example. At the isomiR level, several isomiRs from the miR-215-5p arm were found to be COAD-specific when compared to the other cancer types. Looking at miRNA arms only, we find that the 5p arm of miR-215 also exhibits the same trend, i.e. its production of isomiRs is specific to COAD.

Hierarchical Clustering of Cancers Using Binarized IsomiR Profiles

Figure 1D:
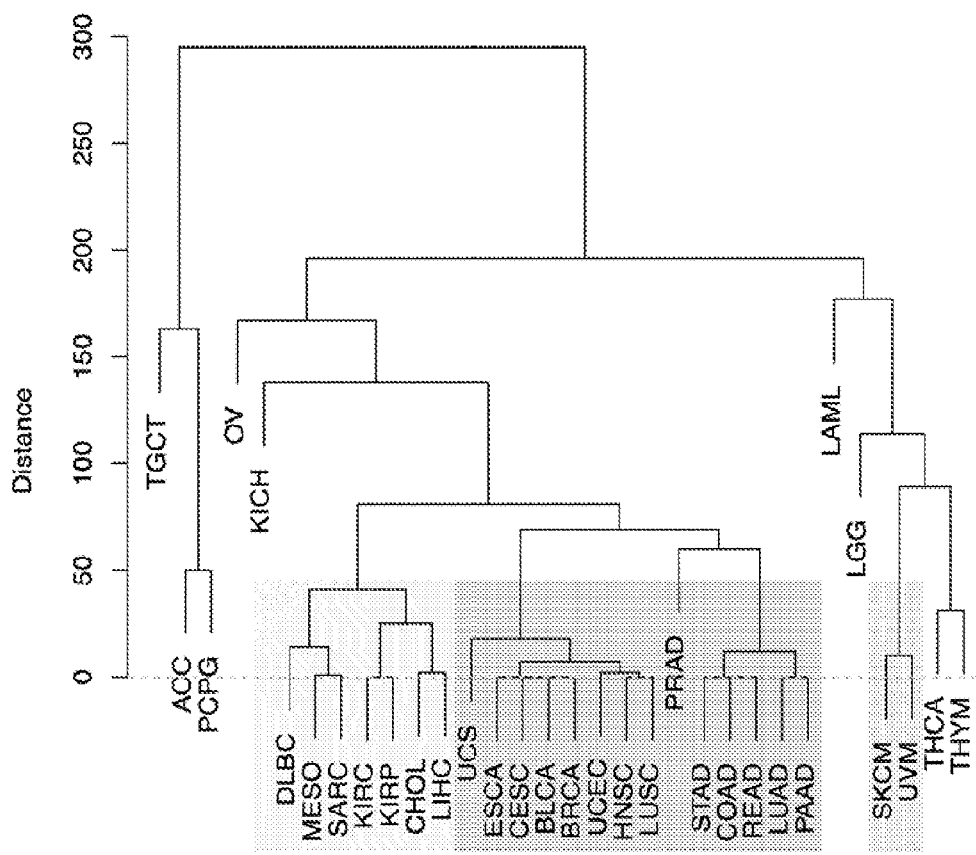

First, we examined how well we can classify the 32 cancer types using binarized isomiR profiles and hierarchical clustering (HCL). As a distance metric between two cancers, we used the Hamming distance between the respective binarized isomiR profiles. Essentially this measures the isomiR differences (present→absent, absent→present) between the two cancers being compared. The resulting dendrogram is shown in FIG. 1D. In it we observe several interesting clusters. A first cluster contains almost all the adenocarcinomas, like PAAD and PRAD. A second cluster encloses the BRCA and BLCA cancer types along with LUSC and head and neck HNSC. A third cluster includes cancers of the kidneys (KIRC, KIRP), liver (LIHC) and the bile duct (CHOL). We also note the clustering of the two melanomas (UVM, SKCM).

The above clustering into tumor groups implies a small Hamming distance and indicates similarities in the profiles of abundant isomiRs. By extension, the profile similarities imply commonalities in the respective molecular physiologies. However, this univariate analysis is not suitable for tackling the multidimensional question of cancer classification.

Conventional Multivariate Clustering Cannot Separate all Cancer Types

Figure 2A:
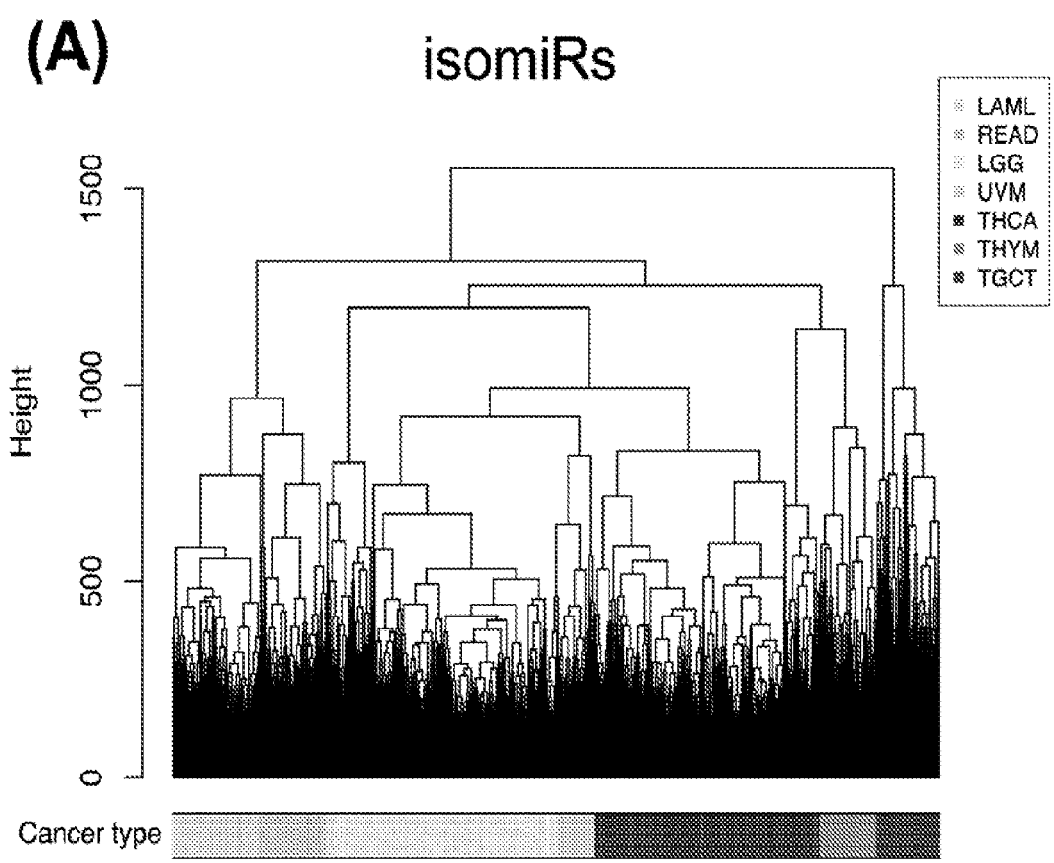
FIGS. 2A-2D illustrate multivariate hierarchical clustering on the binarized expression vectors. (A and B) Hierarchical clustering (hamming distance as metric) on the isomiR (A) or miRNA arm (B) profile of samples from different cancer types. The leaves of the dendrogram are tumor types. (C and D) Networks of all potential pairwise discriminations using hierarchical clustering (hamming distance as metric) on the isomiR (C) or miRNA arm profile (D). Two nodes (cancers) are connected if and only if the corresponding samples were found to form two separate clusters, with the samples of one cancer clustered distinctly from the other.
Figure 2B:
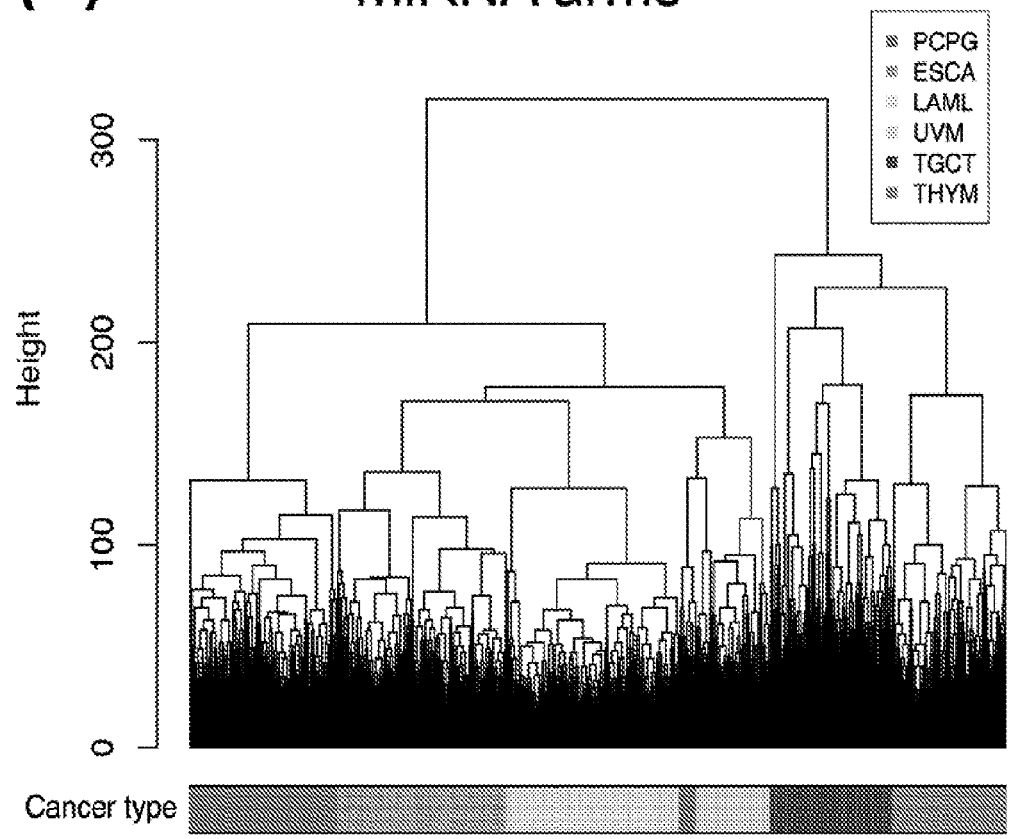

We next embark on multivariate statistical approaches to evaluate the hypothesis that the binarized isomiR and binarized miRNA-arm abundance profiles can be used for tumor discrimination and classification. After computing Hamming distances between pairs of samples (not pairs of cancers) using the respective binarized isomiR profiles, we carried out HCL. We were able to discriminate up to seven cancers using the binarized isomiR profiles (FIG. 2A). Collapsing isomiR profiles into binarized miRNA-arm profiles did not provide any additional discriminatory ability (FIG. 2B). Accordingly, use of HCL and Hamming distances alone, provides for the ability to discern some, but not all cancer types.

Figure 2C:
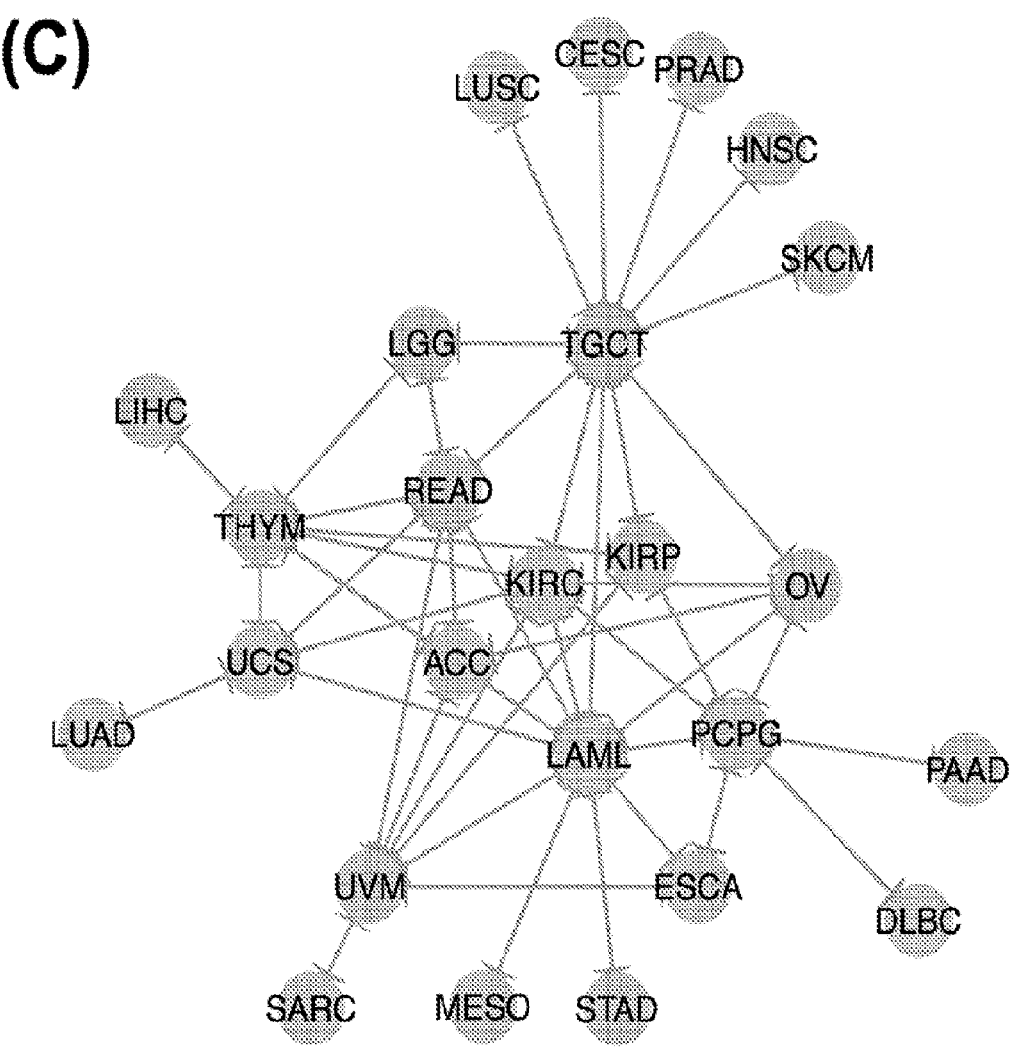
Figure 2D:
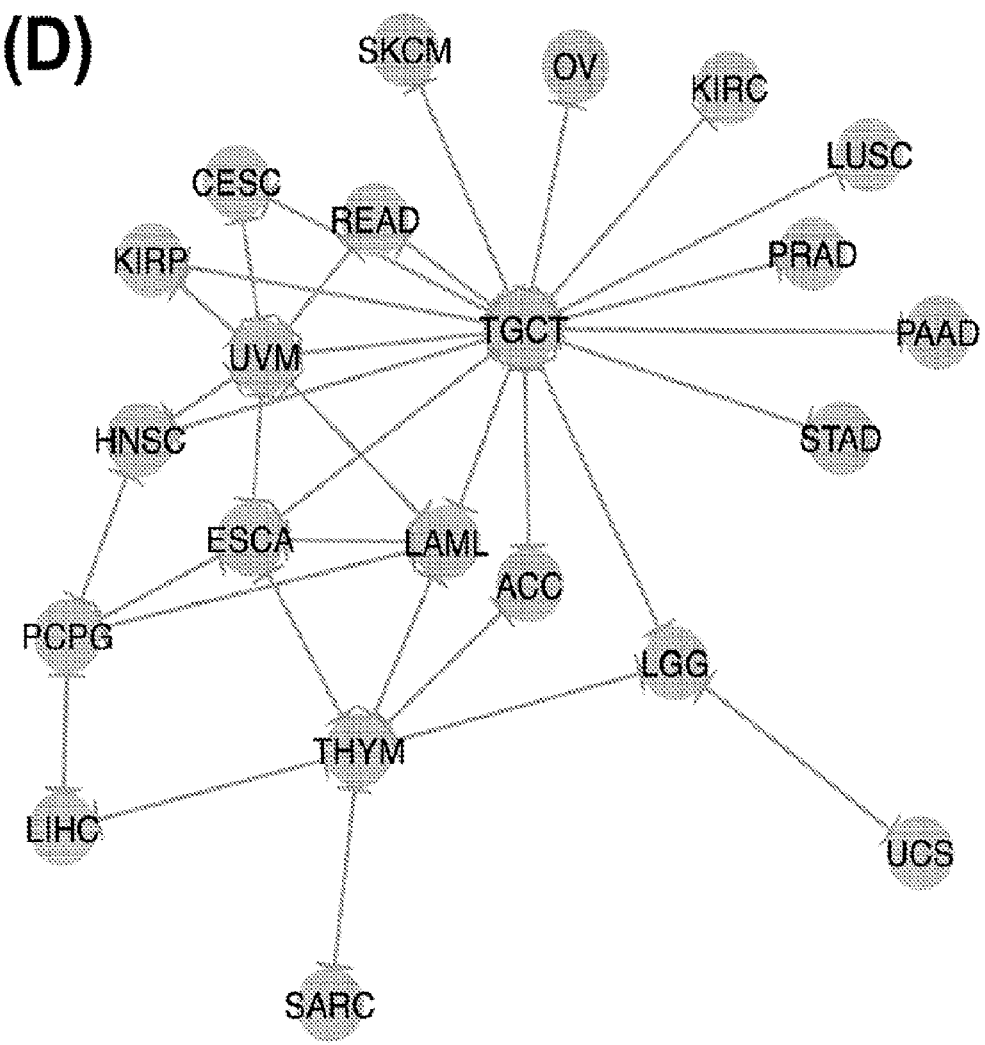

To investigate the upper limit of using HCL and Hamming distances at the sample level, we considered all possible cancer pairs and performed all comparisons among the respective samples. In each case, we examined whether each cancer's samples would form their own cluster. FIGS. 2C (isomiRs) and 2D (miRNA arms) illustrate the outcome of this analysis. In the shown networks, each node is a cancer type. Two nodes are linked with an edge if and only if the corresponding cancers can be distinguished from one another (large Hamming distance between samples from the respective cancers). LAML, TGCT, and THYM appear as central hubs in these networks: this means that these cancers can be distinguished with relative ease from several other cancer types. We note the absence of nodes for e.g. COAD and THCA from these networks. This indicates that, using the current clustering model (Hamming distance+HCL), COAD and THCA cannot be distinguished from other cancers. Also, not surprisingly, binarized isomiR profiles (FIG. 2C) can separate several more cancers from one another compared to binarized miRNA-arm profiles (FIG. 2D).

SVMs Built on Binarized Profiles can Discriminate Among Cancers

SVMs have been gaining popularity thanks to their ability to do multi-class classification in many different contexts (41-45). SVMs are intrinsically designed for binary classifications, i.e. for finding the best hyperplane that separates two a priori defined clusters. For our multi-cancer classification, we used an approach analogous to PhyloPythia, our method for classifying metagenomes (41,42). In particular, we build 496 SVMs for each of all possible "cancer-type-X vs. cancer-type-Y" pairwise comparisons, and, then, integrate the information into a single model by attaching probabilities to the classification outcome. This number is generated by 32*31/2=496, which identifies all unique pairs of 32 distinct items.

We split our 9,291 tumor datasets into training sets (used to construct each model) and test sets (used to evaluate each model), as is general practice in machine learning. Specifically, for each cancer type in turn, we formed a training set that comprised 60% of the type's samples. The remaining 40% of the samples for the cancer type at hand formed the test set. For each cancer type, we used the respective "training" samples to build an SVM aimed at separating the cancer type at hand from the remaining cancer types.

We built 496 SVM models using the "binarized isomiR profiles" and another 496 models using the "binarized miRNA-arm profiles." The isomiR SVM models were evaluated separately from the miRNA-arm SVM models. For the 496 SVM models being considered, we presented each test sample to each of the 496 SVMs in turn and used their output to build a 32-dimensional vector of probabilities: the i-th element of the vector is the probability that the test sample at hand belongs to the i-th cancer type. We imposed a probability threshold of 0.5: if the i-th element of the probability vector was ≥0.5 then the test sample was classified as belonging to the i-th cancer type. If none of the 32 probabilities reached the 0.5 level, then, the test sample was assigned to the 'Other' category. The 'Other' category contains false negatives as well as samples that truly do not belong to the 32 considered cancer types.

Figure 3A:
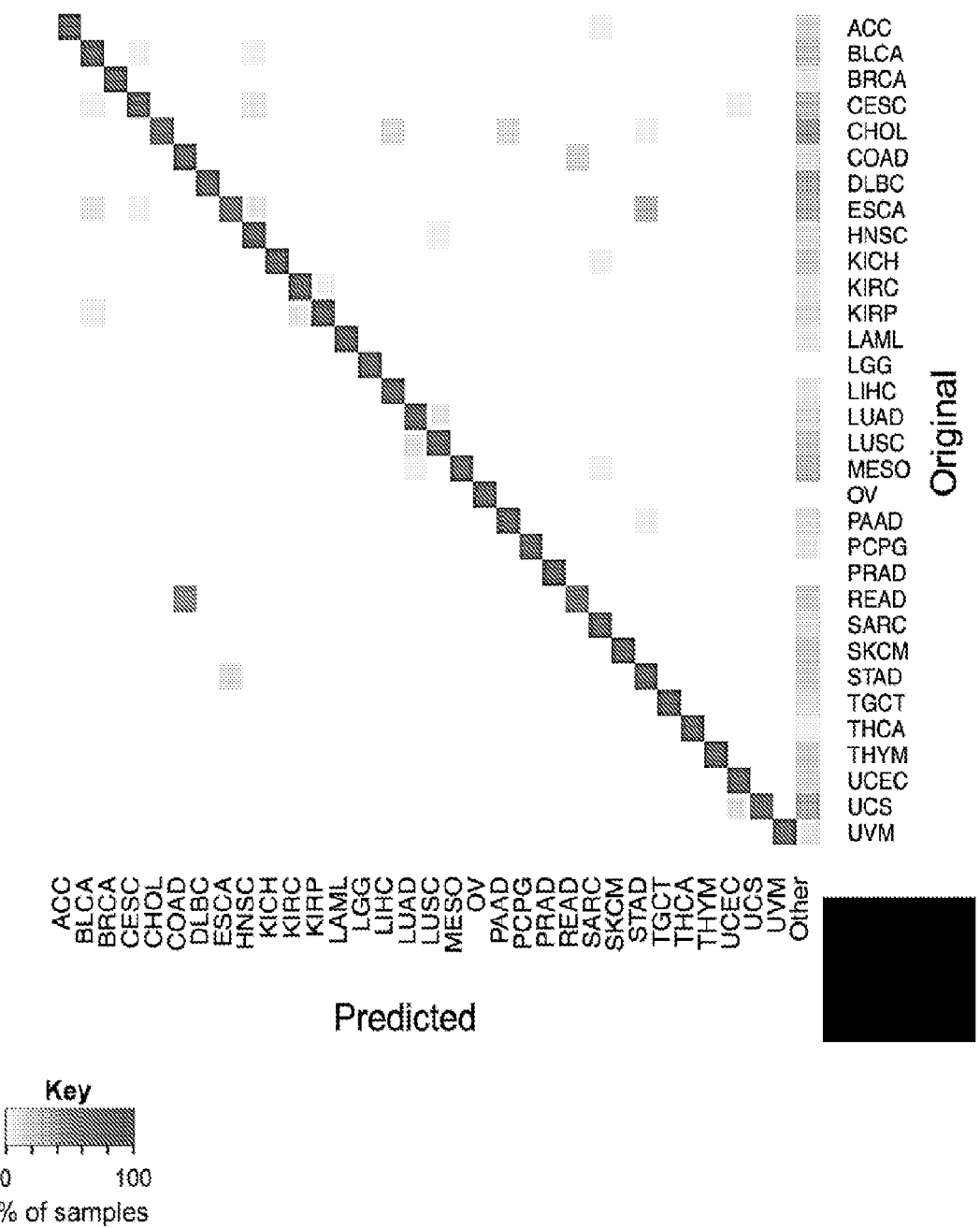
FIGS. 3A-3D illustrate how Support Vector Machines (SVM) correctly classify 32 cancer types. SVM classification using the binarized isomiR (A) or the binarized miRNA arm (B) expression profile. Each row of the heatmap represents the original cancer class and each column the predicted cancer class. The shading of each cell in the heatmap is proportional to the percentage (%) of samples originally as the cancer type in the respective row to be predicted as the cancer type of the respective column. The % is calculated as the average across 1,000 iterations. (C-D) Sensitivity (C) and FDR (D) scores for the SVM models built using the binarized isomiR (darker gray) or miRNA arm (lighter gray) expression profiles.

The SVM model building and testing cycle was repeated for a total of 1,000 times. In each iteration, we used a different set of randomly selected samples for training. FIG. 3A shows a heatmap that summarizes the average prediction performance of the SVMs that are based on the binarized isomiR profiles. Each row designates the cancer type to which the test sample belongs and each column designates the predicted cancer type. A perfectly-specific classifier should not generate any non-diagonal entries. A perfectly-sensitive classifier should not generate any entries in the "Other" category. As can be seen, the binarized isomiR profiles can clearly discriminate among cancer types and to correctly classify each sample to its correct origin. There is one notable instance of seemingly diminished performance that involves several rectum tumors (READ) that were misclassified as COAD tumors. In reality, this is not unexpected considering that READ and COAD tumors are molecularly similar and their distinction is largely driven by anatomy (46).

Figure 3B:
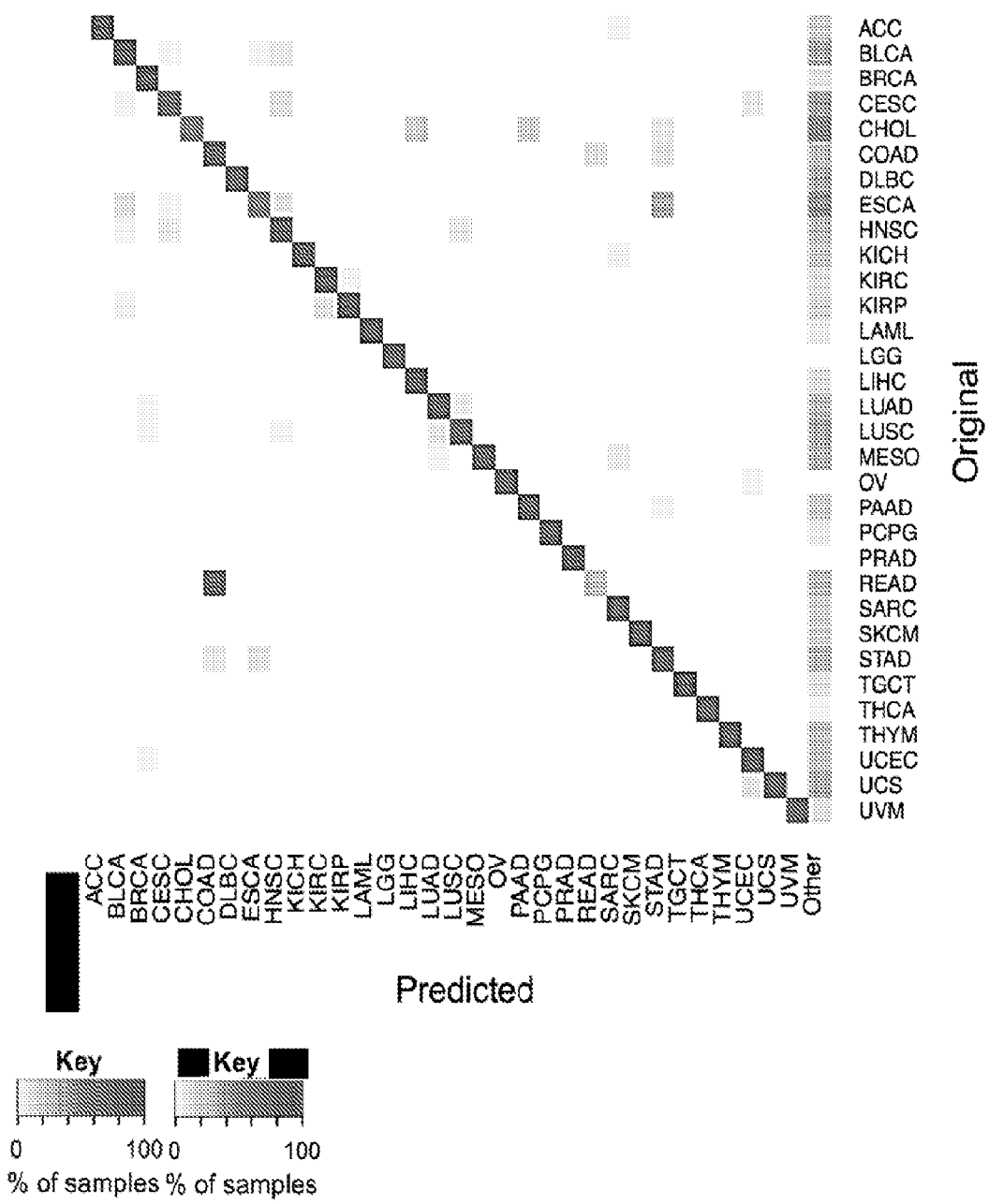

FIG. 3B shows an analogous heatmap that summarizes the average prediction performance of the SVMs that are built using the binarized miRNA-arm profiles. As can be seen, the classification remains largely successful. This suggests that simply interrogating whether a miRNA arm produces isomiRs can provide good performance when classifying cancer samples.

Figure 3C:
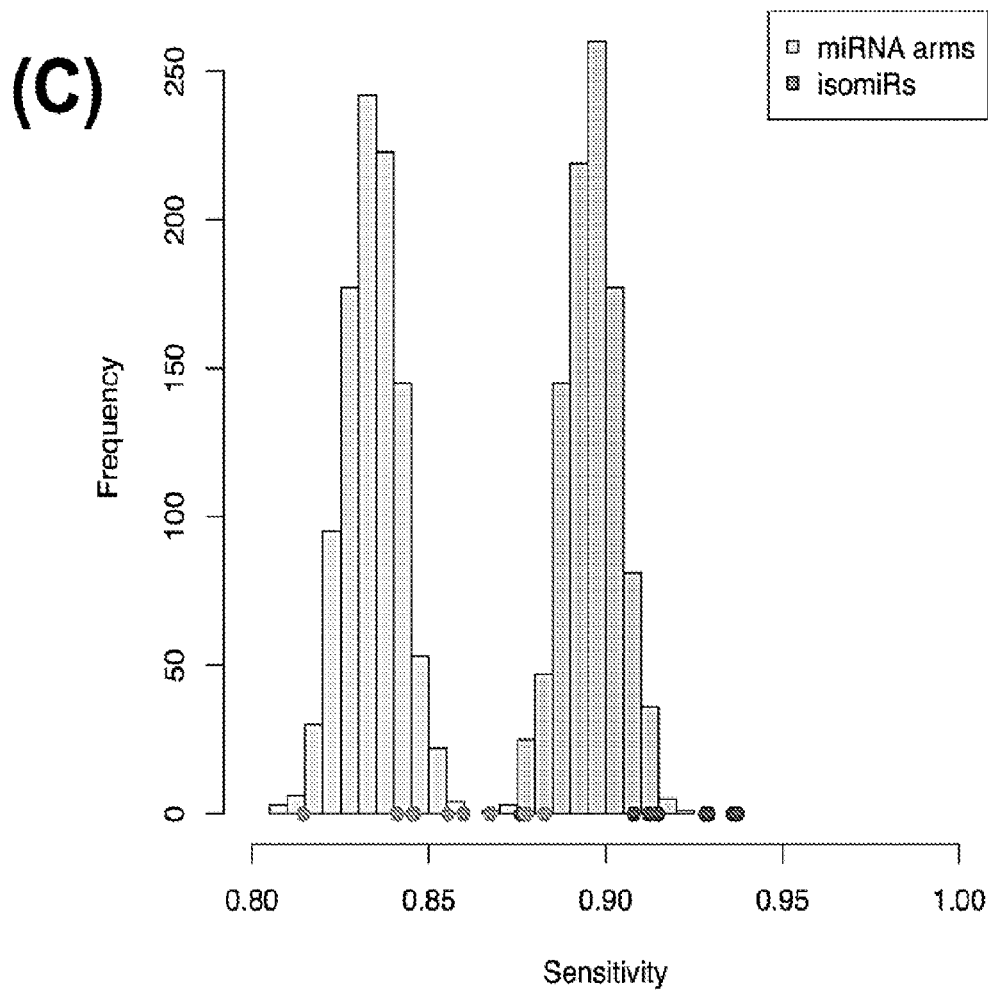
Figure 3D:
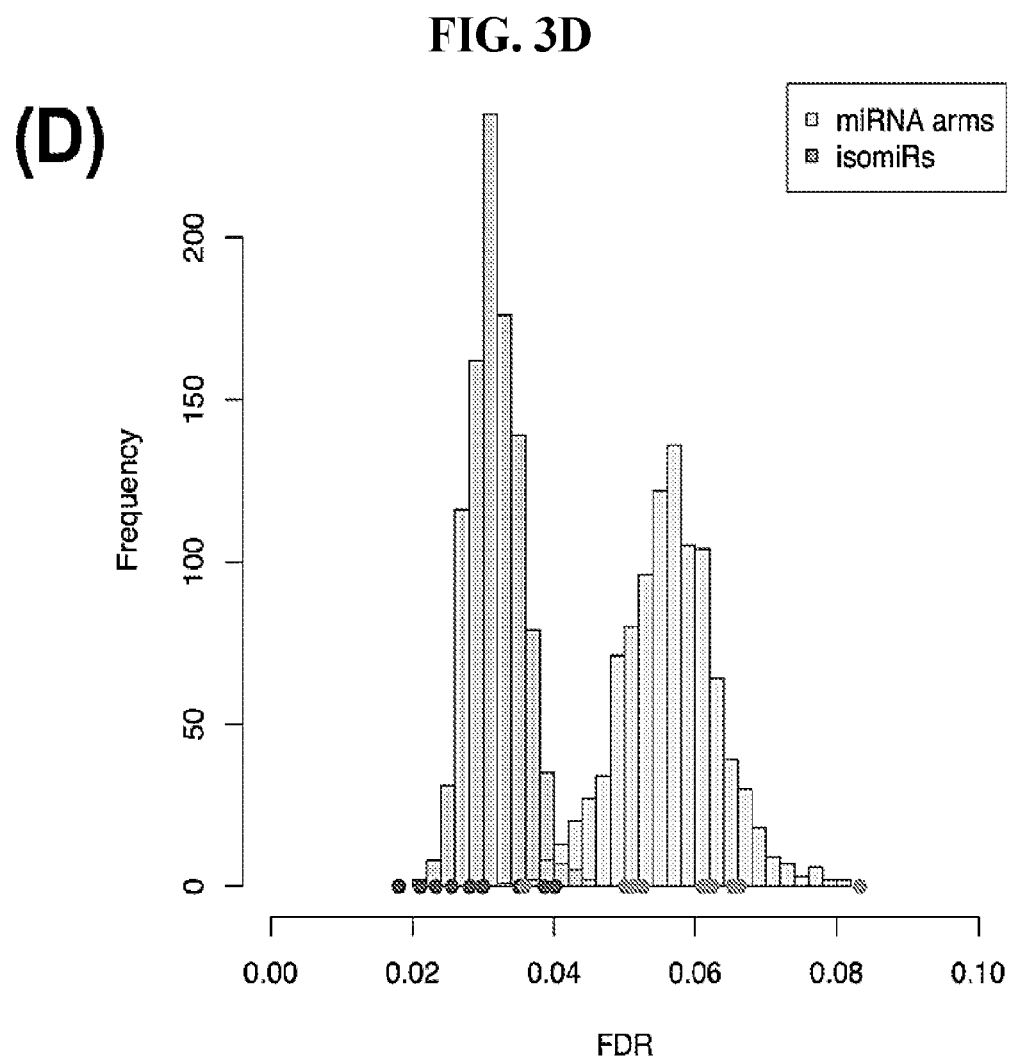

Finally, we quantified the performance of the 1,000 SVM models by building the distribution of the respective sensitivity and FDR scores. We did this separately for the binarized isomiR and miRNA-arm SVM models. FIG. 3C shows the resulting distributions for sensitivity and FIG. 3D for FDR. It is evident that binarized isomiR profiles are considerably more effective in correctly classifying tumor samples showing a mean sensitivity score of 93%. Even though lower (87%), the average sensitivity of the SVMs that were based on the binarized miRNA-arm profiles is fairly high in absolute terms. Indeed, one should consider here the magnitude of the task and how little information is actually used in this case when building these SVM models. The FDR scores also supported the effectiveness of the SVM-based classification. Specifically, the binarized isomiR profiles exhibited a mean FDR of 3%, while the binarized miRNA arm profiles one of 5%.

Validating the Resulting SVM Classification

To validate that the achieved SVM classification is not artificial, we carried out two tests. In the first test, we kept the number of 'present' isomiRs constant but randomly rearranged them in each sample. Then proceeded with building our 1,000 isomiR-based SVM models and testing them with the "correct" test samples. As expected, all of the test samples, in all 1,000 iterations, were assigned to the 'Other' category.

In the second test, we shuffled the labels of the training samples prior to training each SVM model with the binarized isomiR profile. As before, we built 1,000 SVM models and tested them with the "correct" test samples. As before, doing so resulted in the complete collapse of the model.

Based on the outcome of these two tests, we conclude that the classification results depicted in FIG. 3 are not driven by random or accidental events. Instead, the binarized isomiR and miRNA-arm profiles appear to carry actionable information. Accordingly, as described in the methods here, we can utilize these binarized isomiR and miRNA-arm profiles to classify a particular sample as pertaining to a specific cancer type. Upon classification, treatment of that patient can be tailored to the particular therapeutic that targets that specific cancer.

The Most Discriminatory IsomiRs and miRNA Arms are not Among Those Frequently-Studied As the SVM attempts to identify the best-separating hyperplane in the multidimensional space, some of the features are given more weight than others. In our case, these features would be tantamount to specific isomiRs and specific miRNA arms respectively.

To identify those isomiRs that were deemed most significant in separating the various cancer types, we ran the SVM method using as training set the whole TCGA dataset and extracted the variable importance (VI) score for each variable as the mean of the squares of the feature weights (47) of all pair-wise comparisons. We repeated the same analysis for miRNA arms and identified those with the highest VI values.

Among the isomiRs, we found that two isomiRs from the 5p arm of miR-205 were deemed most important by the isomiR-based SVM classifiers. These were followed by several isomiRs from both arms of miR-141. Notably, we observed a trend for agreement between the SVM models built on isomiR profiles and miRNA-arm profiles respectively with regard to the miRNA loci that the two models deem important. The loci include miR-205, miR-141, and miR-200c.

To validate these findings, we used the RandomForest algorithm, which has been shown able to identify significant variables for classification (48). We found the VI scores from RandomForest to be strongly and positively correlated with the VI scores from the SVM models: Spearman rho correlation coefficient 0.886 (P-val<0.01). The correlation improves further to 0.932 (P-val<0.01) when we compare the VI scores obtained from the binarized miRNA-arm models. The fact that a second independent algorithm validates the SVM conclusions adds further support to the relevance of using binarized profiles.

Figure 4A:
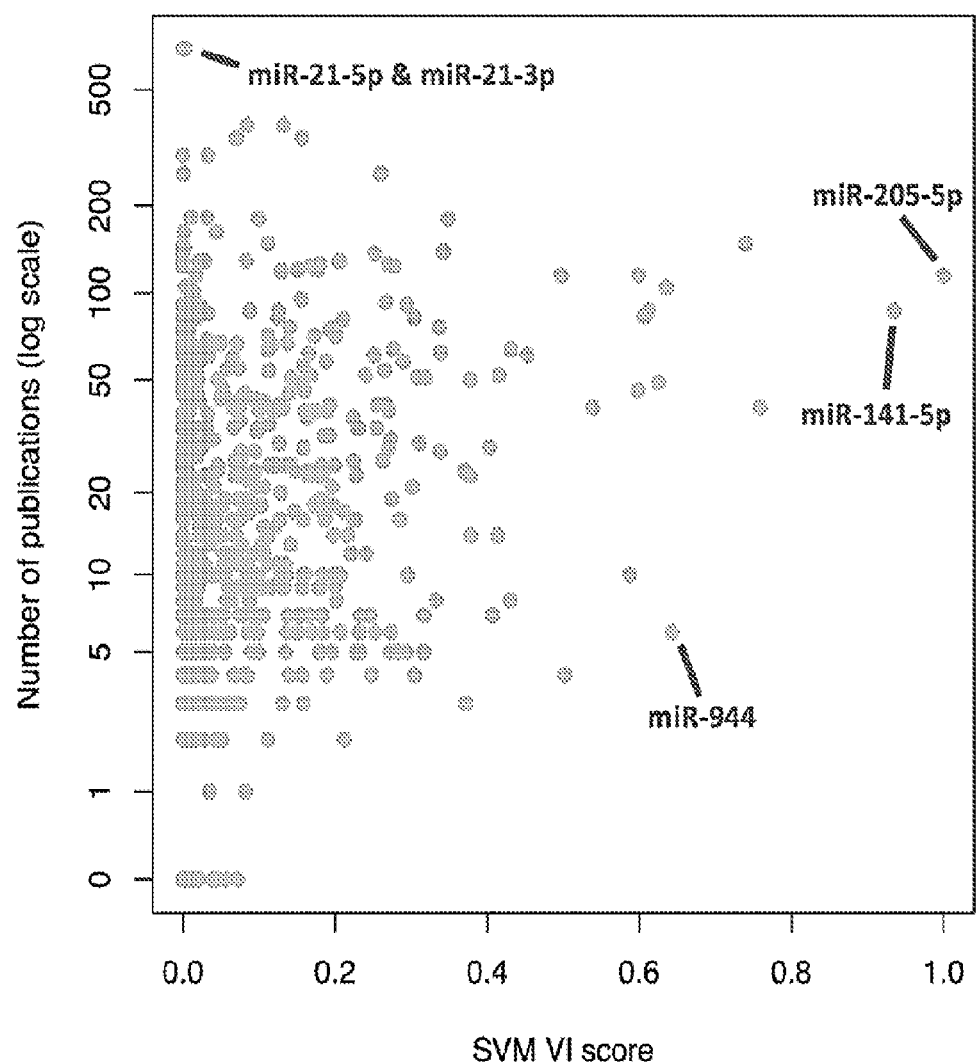
FIGS. 4A-4B illustrate how the number of publications does not correlate with the importance of a feature for classification purposes. (A) Number of publications against the variable importance (VI) score as calculated from the SVM classification model based on miRNA arms. Spearman correlation coefficient=0.303. (B) Number of publications with the word "biomarker" or "signature" in their title against the "variable importance" (VI) score as calculated from the same SVM. Spearman correlation coefficient=0.123.
Figure 4B:
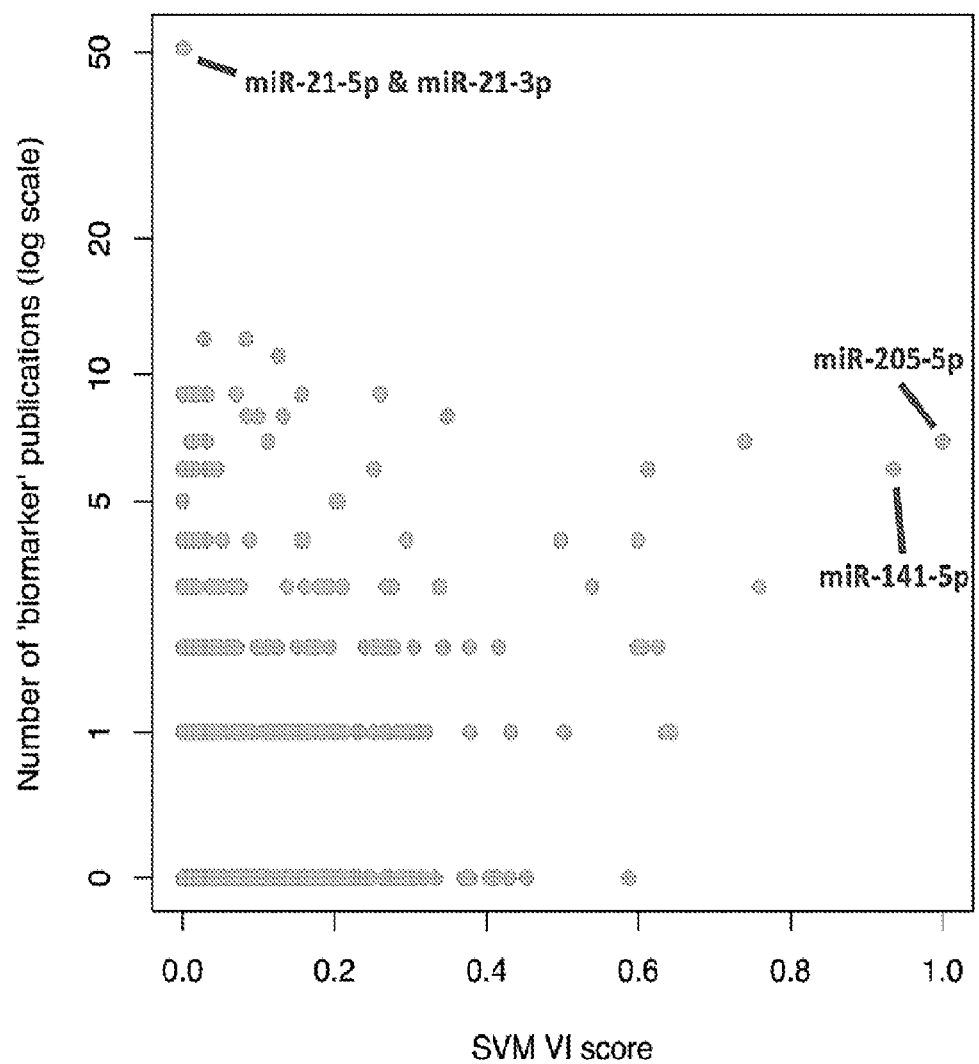

Having confirmed with two independent machine-learning tools the VI scores, we associated the corresponding molecules with the number of PubMed. For this step, we specifically used those miRNA loci that have entries in the Gene database of NCBI and retrieved the number of Pubmed entries associated with each miRNA gene. FIG. 4A shows the result of this association for SVMs using binarized isomiRs as features. FIG. 4B shows the result of this association for SVMs using binarized miRNA arms as features. We observed a mean of 52 publications per isomiR and 30 publications per miRNA arm. A striking result of this analysis is that both arms of the mir-21 precursor are each associated with the highest number of publications. However, with regard to their ability to classify cancer samples, both the SVM and RandomForest models assign miR-21 a considerably low VI score (little discriminatory power). It is also important to underline that both the SVMs and the RandomForest deemed miR-944 to be among the most important miRNAs for cancer classification: miR-944 currently has only six PubMed entries (FIG. 4). Other examples of discriminatory miRNAs with few PubMed entries include miR-429 (87 entries), miR-192 (46 entries), miR-194 (10 entries), and miR-135b (40 entries).

Lastly, we repeated the above analysis with one change. Specifically, we examined the correlation of the VI score with the number of times that the isomiR, or miRNA arm respectively, is found to differentially present in a pairwise comparison. We found that the isomiRs and miRNA arms that had the most impact on cancer classification were the ones that were found to be differentially present among many cancer types and not the ones that were uniquely present or absent in one cancer type. Similar results were obtained for both isomiRs and miRNA arms under the RandomForest model as well.

Summarily, the above findings suggest that the current body of literature is somewhat limited in regards to studies of miRNAs with the potential to be cancer-specific biomarkers.

The Ability to Classify with SVMs Trained on Binarized Profiles Remains when Only a Reduced Set of Features is Used The above-mentioned SVM and RandomForest models considered all 7,466 present isomiRs (isomiR profiles) or all 807 present miRNA arms (miRNA-arm profiles). As we discussed in the previous section, the various isomiRs and miRNA-arms have variable value in cancer classification. Based on these observations, we investigated the possibility that we could obtain reasonable classification results using a reduced set comprising the most important features (isomiRs or miRNA arms, FIGS. 5A and 5B, respectively). By reducing the number of classifications, we can dramatically reduce the cost and time required to make a determination.

Figure 5A:
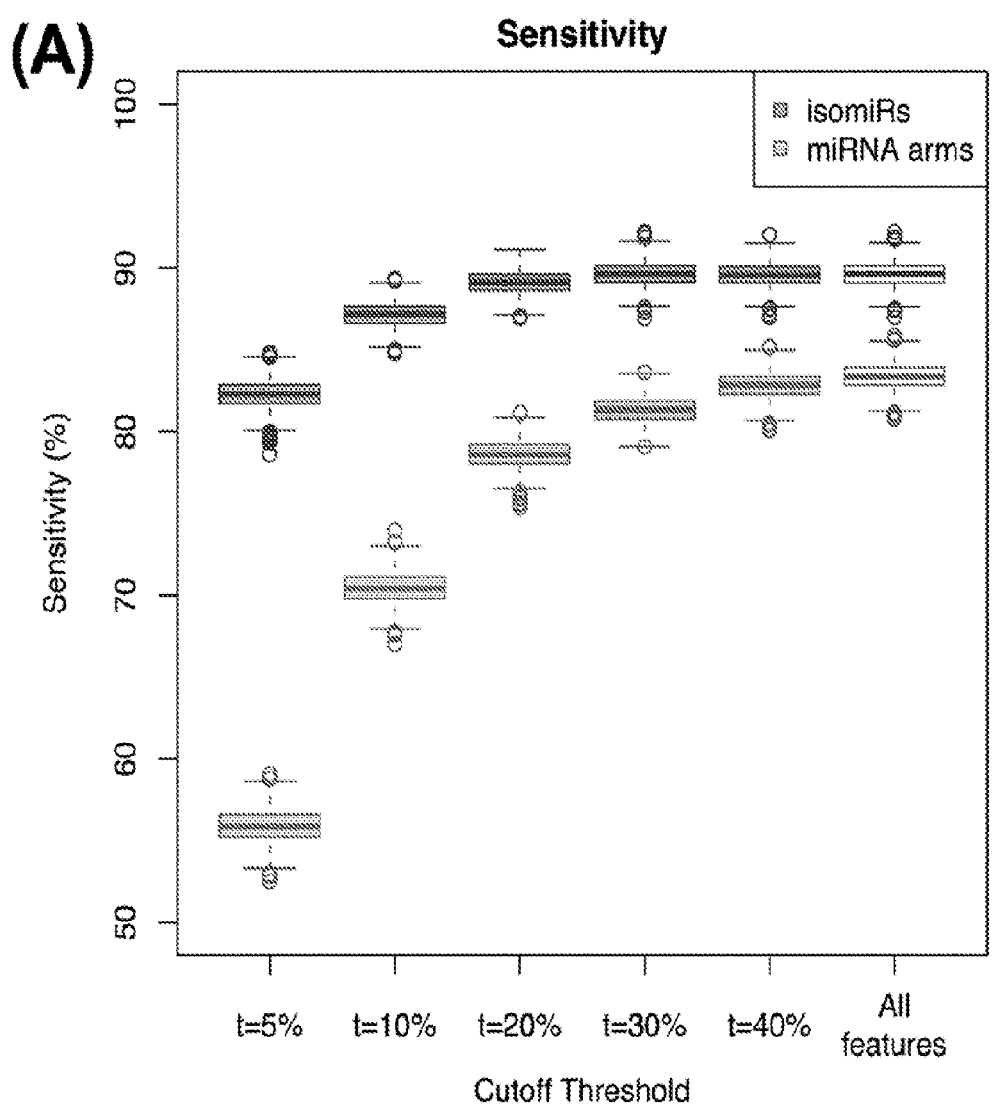
FIGS. 5A-5B illustrate how the sensitivity and FDR of SVM classification change when reduced lists of features are used. The plots correspond to the case of a classifier that is built to distinguish among 32 cancers. (A) Boxplots showing sensitivity for isomiRs (dark gray) and miRNA arms (light gray). (B) Analogous boxplots showing the FDR for the corresponding SVM, for isomiRs (dark gray) and miRNA arms (light gray).
Figure 5B:
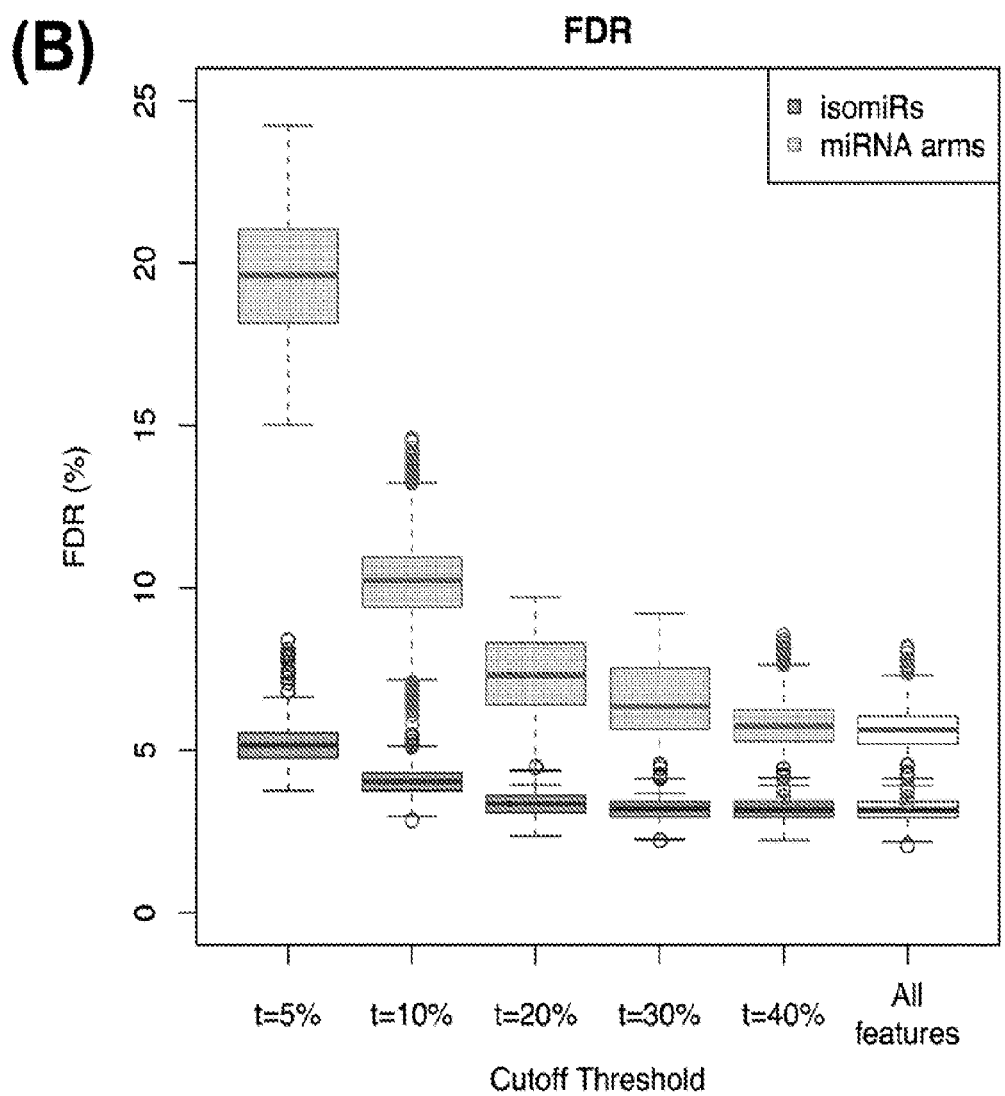

We used the top 456 isomiRs and repeated the multi-cancer SVM-based training and classification. We found that even with this reduced set of isomiR features we maintained our ability to correctly classify samples—the concomitant sensitivity following 1,000 training/testing iterations decreased to 82% (FIG. 5A) and the FDR increased by a mere of 2% to 5% (FIG. 5B). Much of the error originated from the higher uncertainty of the method to classify samples, as evidenced by the higher number of samples clustered as "Other."

We also repeated the analysis using a reduced set of most important miRNA-arm features to build our SVM models. We intersected the top 10% most important miRNA arms of the SVM model with the top 10% miRNA arms of the RandomForest and obtained 47 arms. This signature of miRNA arms was sufficient to classify the samples to their respective cancer type (FIG. 5A) at the expense of a modest penalty in sensitivity (decreased to 70% from 83% when all features were used) and FDR (increased to 10% from 6% when all features were used, as seen in FIG. 5B). These results suggest that the reduced set of miRNA arm features retains a considerable ability to classify cancer samples, albeit it does not reach the levels achieved by isomiRs. On the other hand, the miRNA-arm-based SVMs achieve these results using ten times fewer features than isomiRs.

Clinical Studies

In this study, we described the usefulness of the binarized isomiR and miRNA arm profile in multiple cancer types. We based our work on previous observations that tissue-specific expression profiles exist (28, 29, 37, 49) and tissue and cell type differences can be adequately described by only the presence or absence of RNA transcripts (39, 40). We were centered on isomiRs, as our previous work was able to justify the importance of these molecules (31, 35) and their contribution to better understand BRCA heterogeneity (31). Therefore, our over-arching goal was to investigate how well binarized profiles of isomiRs and miRNA arms describe cancer types. To this end, we leveraged the TCGA datasets due to the standardized protocols and data availability (36).

After fixing several caveats on the reported profiles, including multiple counting (36), we first identified several instances of cancer-specific expression or cancer-specific loss of expression of several isomiRs and their corresponding arms. The most striking example is miR-9 and its isomiRs that are uniquely present in LGG tumor samples.

This miRNA is highly expressed in the nervous system and has evident important roles in neuronal development and diseases (50, 51) supporting our findings of its tissue-specificity. Another miRNA that also exhibited similar characteristics in LGG was miR-219 and, intriguingly, this miRNA has been implicated in neural differentiation processes (52). We were also able to identify additional miRNAs that have almost unique expression in some tissues, like the liver-specific arms of miR-122 (53). Our unbiased and global approach also identifies potential cancer-type-specific miRNAs, like miR-671 in ovarian cancer or our novel miRNA ID00737-3p in THCA (Supplementary Tables S3 and S4—as provided in Application No. 62/411,417). OV was also an interesting case as it had a relatively high number of isomiRs and miRNA arms absent as compared to other cancer types. The opposite was, however, true for TGCT tumor samples that exhibited unique presence of several isomiRs and arms, especially from the miR-302 family (Supplementary Tables S3 and S4—as provided in Application No. 62/411,417), that has been shown to be important in pluripotency of stem cells and cell reprogramming (54, 55).

Causative links for the above observations cannot be identified based on our analysis. The cancer-specific expression can also not be guaranteed, as the isomiRs and the miRNA arms can preserve tissue-specific expression trajectories, even in the cancerous state. Indeed, cellular context matters in cancer biology (56) and may contribute to cancer-type differences. As the TCGA projects were largely focused on tumor classifications, limited normal samples were analyzed. Further studies with balanced numbers of normal samples will be needed to decouple the "normal" from the "cancer" signal, as done previously but with a considerably smaller sample size (28). Focusing on tissue specific molecules is of great importance here. On the other hand, miRNAs that are ubiquitously expressed in multiple tissues are not very informative. For example, miR-21-5p, the miRNA with the highest number of publications, and several members of the let-7 family are present in all the samples and all the cancer types of our study. This characteristic means these miRNAs would not be useful in pinpointing a patient's ailing tissue, which would be a prerequisite for a specific therapy recommendation (57). Towards this direction, several recent studies suggest the use of panels of miRNAs rather than single molecules for biomarkers (58-60).

Having established that qualitative differences among cancer types exist and are meaningful, we next employed multivariate and machine learning tools to build classification models and predict the cancer type solely based on binarized expression information of isomiRs or miRNA arms. We found that SVMs that are built using binarized isomiR profiles were capable of correctly predicting the cancer class with 90% sensitivity and 3% FDR (FIG. 3). The performance of SVMs that use isomiRs was better than SVMs that use miRNA arms as features and persisted when reducing the isomiR vector one order of magnitude (FIGS. 5A and 5B). Independent evidence of higher discriminatory power of isomiRs against miRNA arms is limited but start to emerge. In a recent work, Koppers-Lalic et al. found that miRNA isoforms are able to improve the specificity for prostate cancer detection, including isomiRs from the miR-204-5p, miR-21-5p and miR-375-3p arms (61). In addition, our previous work in breast cancer showed that isomiRs can better distinguish normal breast tissue from BRCA tumors as compared to archetype miRNAs (35). Potential reasons for the higher predictive value of isomiRs can be that quantification and modeling at the miRNA arm level is inherently bound to lose information, especially information rooted in biological mechanisms that can specifically affect isomiR levels (62-64).

A Case for miRNA-Arm-Based Approaches

Despite the evident superiority of using isomiRs as features, one can envision situations where cost and efficiency are important considerations. In such cases, employing an miRNA-arm-based classifier, instead of an isomiR-based one, represents a reasonable compromise between sensitivity and specificity.

For many years, quantification of short molecules like miRNAs has been relying on methodologies that do not attempt to guarantee the target molecule's endpoints. This is not surprising considering that until very recently scientists had no reason to suspect that the production of isomiRs is, in fact, constitutive in nature. Consequently, such methodologies would simultaneously amplify, and, thus, quantify as an aggregate the multiple isoforms of a short molecule, if the sequences of these isoforms differed from one another only a little. Methodologies that have been very popular with users include Affymetrix's Expression Arrays®, Nanostring's nCounter®, and other.

In light of the findings described in FIGS. 3 and 5, quantification assays that allow us to declare a miRNA arm as present without any regard to which isomiRs specifically are produced from that arm represent an opportunity. Ideally, one would like to use just enough assays to reach the plateau of sensitivity and FDR. The data in FIGS. 5A and 5B suggest that between 115 and 198 miRNA-arm features will achieve this goal. Importantly, such a classifier could be implemented by using the existing, off-the-shelf assays that have been used all along to quantify molecules in the pre-isoform era. In other words, an easy-to-put-together, reasonably-well-performing, reasonably-low-cost solution is within reach and would not require any additional development costs.

A further embodiment is directed towards a method for classifying cancer using miRNA arms using between 10% and 40% of all arms provided by the methods described herein.

In preferred embodiments, it is preferable to use between 20% and 30% of all the isomiRs or miRNA arms.

One such case that we studied in depth was that of STAD. Here, we began by posing the following slightly-different question: "can we determine whether this sample belong to STAD and not to any of the remaining 31 cancer types?" Again, we used SVMs to build a classifier to answer this question.

Figure 9A:
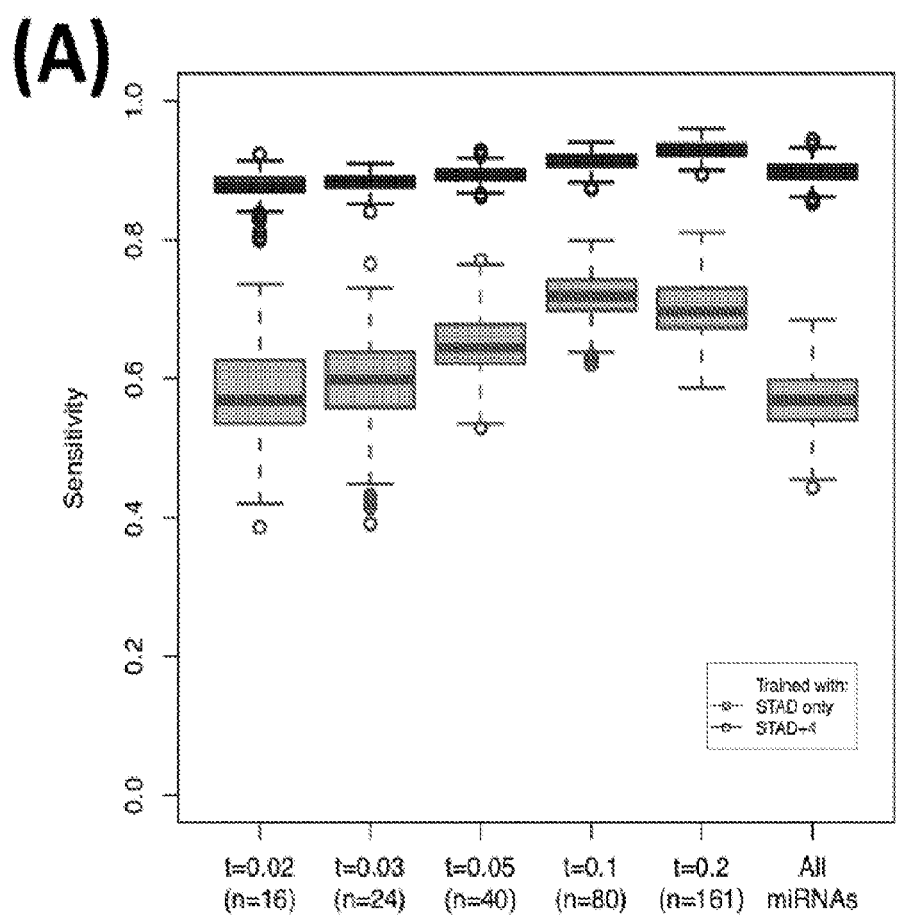
FIGS. 9A-C illustrate how the sensitivity and FDR of SVM classification change when reduced lists of features are used. The plots correspond to the case of a classifier that is built using the arms of miRNAs as features and aimed at specifically identifying STAD samples (light gray) or STAD+ESCA+PAAD+COAD+READ samples (dark gray). Shown are Sensitivity (A), Specificity (B) and False Discovery Rate (C) for the classifier (n=400 iterations) trained with all the miRNAs (righmost boxes on each plot) or a subset of the most discriminatory miRNAs (rest of the boxes) as identified by the runs with all the molecules.
Figure 9B:
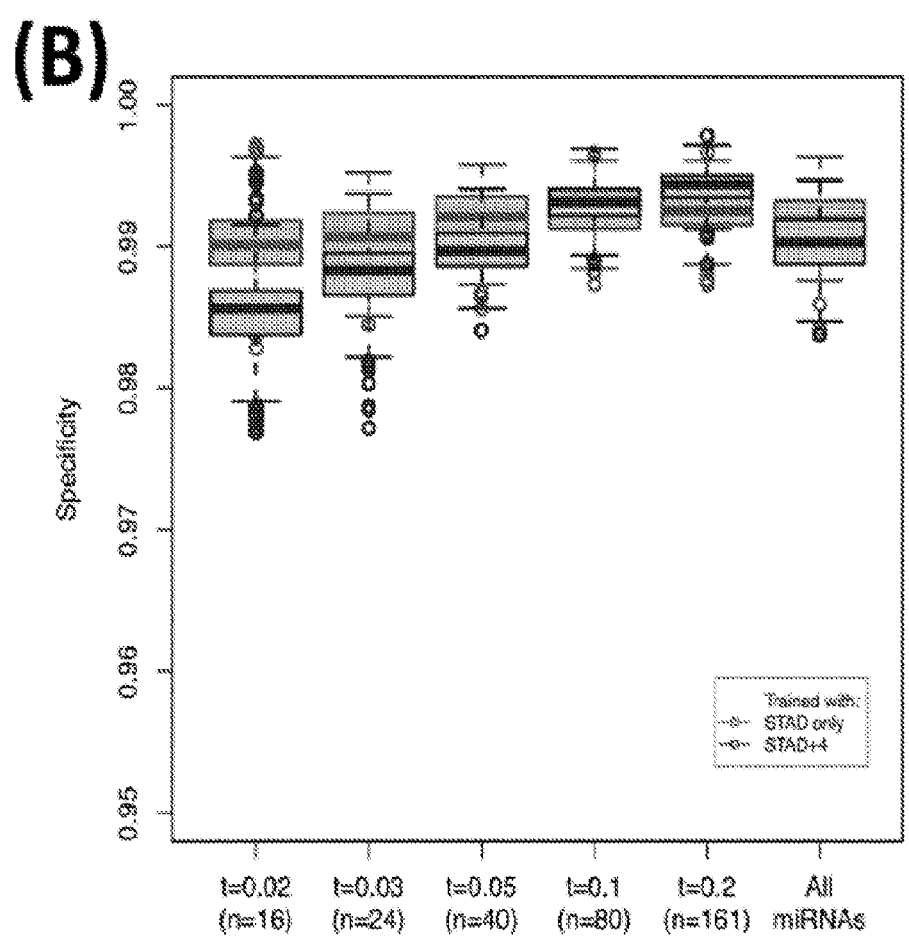
Figure 9C:
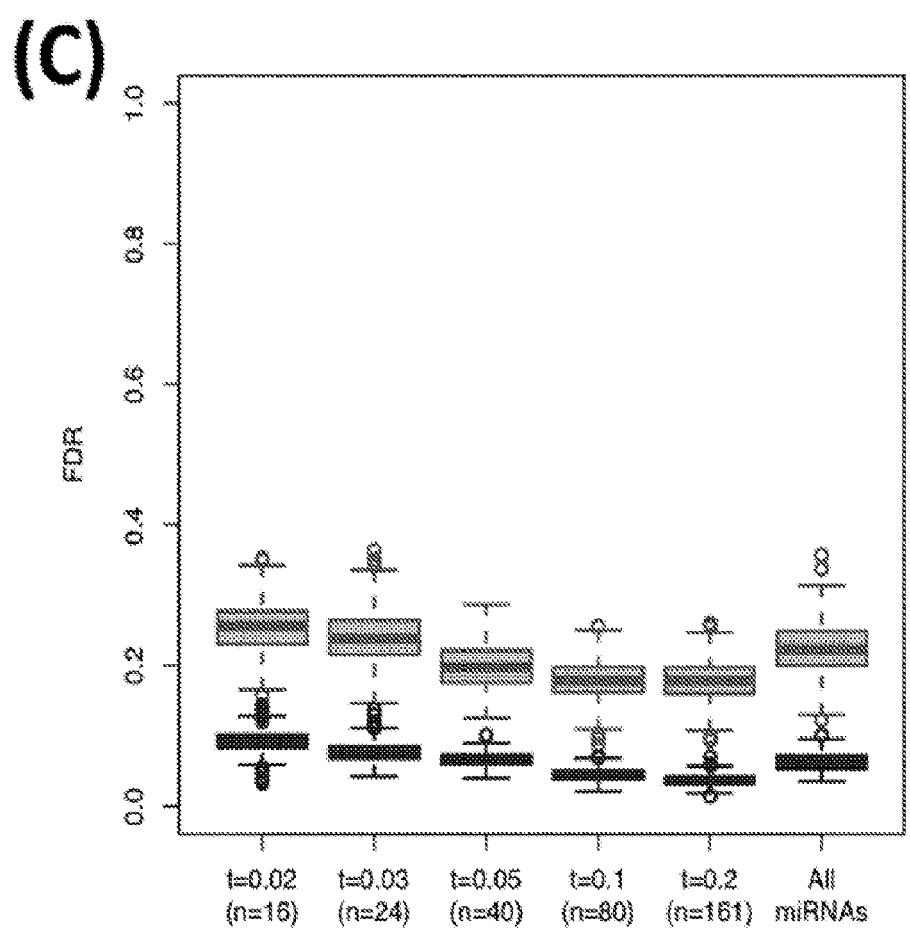

As features we used binarized miRNA-precursor arms. The resulting model's sensitivity was around 60%, i.e. much lower than the original 83% that we achieved with the binarized miRNA-precursor arms when we tackled the 32-way classification question (light gray boxes in FIG. 9A). Nonetheless, the classifier's specificity was high whereas its FDR was around 23% (light gray boxes in FIGS. 9B and 9C).

The low sensitivity was rather surprising considering that the classifier was now tackling a 2-way classification problem, instead of the original 32-way one. We suspected that some of the 31 non-STAD cancers had "STAD-like" isomiR profiles. These other profiles were likely "confusing" the classifier.

In light of these observations, we rebuilt our SVM classifier by identifying the few cancers that were most similar to STAD. There were four cancer types that had no differentially present miRNA arm when compared to STAD ([65]). It turns out that all four cancers belong to the gastrointestinal tract. The four cancers that are most similar to STAD are: ESCA, PAAD, COAD, and READ, i.e. esophageal, pancreatic, stomach, colon, and rectum cancers, respectively.

In light of this finding, we pitted these five cancers (STAD, ESCA, PAAD, COAD, READ) against the remaining 27 cancers. The resulting sensitivity, specificity, and FDR (dark gray boxes in FIGS. 9A-C, respectively) of the new classifier were markedly improved. The sensitivity again reached 90% whereas the FDR dropped to 6%.

We also studied the quality of the classification by training with increasing numbers of binarized miRNA-precursor arm features. Specifically, we ranked the features in order of decreasing VI, i.e. in order of decreasing ability to discriminate. We then selected and trained using 16, 24, 40, 80, 161 and all miRNA arms, respectively. The performance (sensitivity, specificity, and FDR) in each case can be seen in FIGS. 9A-C. As is evident, using only 16 miRNA arms as features to train a classifier in the case of STAD+ESCA+PAAD+COAD+READ vs. 27 cancers allows us to achieve a high sensitivity (90%) with a small FDR.

Even though our analyses and the building of the new classifier were driven by our initial focus on STAD, the resulting system could also be used for labeling samples that may belong to ESCA, PAAD, COAD, or READ. To this end, we used the approach that we described in the previous paragraph to evaluate the sensitivity, specificity, and FDR of the classifier when it is presented with samples from each of these four cancers in turn. The table below shows the results. With the exception of ESCA, the classifier performs really well in each case. Of particular note here is the case of PAAD (pancreatic ductal adenocarcinoma), an aggressive type of cancer for which there is an urgent need for diagnostics and therapeutics.

|  | Sensitivity | Specificity | FDR |
| --- | --- | --- | --- |
| COAD | 98.1 +/− 1.1 | 99.9 +/− 0.0 | 1.2 +/− 0.9 |
| READ | 96.7 +/− 2.2 | 100.0 +/− 0.0 | 1.7 +/− 1.9 |
| PAAD | 91.0 +/− 4.0 | 99.9 +/− 0.0 | 4.0 +/− 2.4 |
| ESCA | 57.7 +/− 5.8 | 99.7 +/− 0.1 | 19.2 +/− 5.6 |
| STAD | 92.4 +/− 1.9 | 99.7 +/− 0.1 | 5.0 +/− 1.6 |

Therapeutic Treatments and Testing

A patient presents herself at the physician's office with chest pain. After an examination, the physician recommends imaging. The latter reveals a mass in the individual's liver. A biopsy confirms the presence of cancer. However, the tissue of origin is inconclusive, thus making treatment difficult.

Accordingly, we took a clinical sample and processed the obtained clinical sample, to extract total RNA from it. We performed quality control on the extracted RNA to verify that it is appropriate for further processing. Then, taking a portion of the extracted RNA, we performed a series of reactions to isolate the short RNA molecules and prepare them appropriately for deep sequencing.

Upon completion of the sequencing, we retrieved all the sequenced reads, and processed them to identify the quantity of each present molecule. Then, we binarized the expression profile: all isomiRs with abundances in the top 20% were considered 'present,' and 'absent' otherwise. Subsequently, we processed this profile with the SVM classifier whose performance is summarized in FIG. 5.

The classifier returns 32 probability scores whose sum is equal to 1. The i-th such score represents the probability that the sample belongs to the respective cancer type. We would choose the cancer type with the highest probability only if this probability exceeded 0.5. If not, then we would conclude that there is not enough signal that would allow an unambiguous classification. A review of the particular sample reveals that the classifier is pretty confident returning a computed probability for "OV" that is well above 0.5: our patient has "ovarian cancer" and paclitaxel is administered to the patient for treatment.

Those of skill in the art will recognize that determination of the cancer leads to a specific and particular therapeutic for treating the metastatic cancer cells.

Assaying Small Collections of Target Molecules

To employ a classifier that is based on isomiRs one can envision a scenario where, for example, deep-sequencing is used to quantify the isomiRs that make up the classifier. Deep sequencing is clearly a much more costly proposition when is interested only in a handful of isomiRs. In such a situation, one can envision a custom-designed molecular "panel" that includes "probes" that specifically quantify only a handful of isomiRs of interest. Each one of these probes will need to exhibit both 5' and 3' endpoint specificity, namely be able to quantify the target isomiR while being as un-responsive as possible to other isomiRs that may be present in the milieu and differ from the target isomiR at either the 5' terminus, the 3' terminus, or both. A technology that is potentially applicable here is "dumbbell-PCR" [66]. Also, the miR-ID method [67] could be adapted for use with isomiRs. It is conceivable that other similar approaches will also become available in the future and could be used as well. Designing assays that are sensitive to changes in the target molecule's endpoints is feasible but their optimization may require a lot of effort. Thus, one consideration in selecting such a method is its scalability characteristics.

More on "Meta-Arms"

As we mentioned above, some isomiRs may have ambiguous origins. I.e. there may be multiple miRNA loci from which they could be originating. This becomes a consideration when we use miRNA arms as features of the classifier because it requires that we combine the potential genomic sources into a single entity. While the "label" by which we refer to such an entity is unique, the "sequence" that we can attach to it may not be necessarily. This is due to the fact that although the corresponding miRNA arms share the sequence segment that matches the isomiR, the sequences of the miRNA arms that contain the isomiR can differ. For example, the isomiR GCGCTTCC combined with CTTTGGAG could be originating from either GGAAAAGAA combined with

GGCGCTTCC combined with

CTTTGGAG combined with TGTTA (the 3p arm of miR-524, which is not among the list of sequences included in this application) or from

AAAAGAAGGCGCTTCCCTTTGGAGTGTTA (the 3p arm of miR-525, which is listed as SEQ ID NO. 8015). Since the goal is to be able to capture all such sequences we have introduced a regular expression notation that makes use of square brackets '[' and ']' as follows. [AC] indicates that a specific position can be occupied by either an A or a C. An example is SEQ ID NO: 7468 whose sequence is

CTTCCCTTTGTCATCCT[AT][CT]GCCT[AG][AG].

The way to interpret it is that

CTTCCCTTTGTCATCCT, which is shown underlined in in the previous sentence, as a portion of SEQ ID No. 7468, can be followed by either A or T, which can be followed by C or T, which can be followed by GCCT, etc. Among the 8,595 sequences mentioned in this application there are 67 entries that fall in this category that comprise 43 distinct regular expressions.

The disclosure refers to citations, shown in parentheses, e.g. "(10)", which designate references listed below.

REFERENCES

1. Hood, L. and Rowen, L. (2013) The Human Genome Project: big science transforms biology and medicine. *Genome medicine*, 5, 79.
2. Veneziano, D., Di Bella, S., Nigita, G., Laganà, A., Ferro, A. and Croce, C. M. (2016) Noncoding RNA: Current Deep Sequencing Data Analysis Approaches and Challenges. *Hum. Mutat.*, 1-16.
3. Aalto, A. P. and Pasquinelli, A. E. (2012) Small noncoding RNAs mount a silent revolution in gene expression. *Current opinion in cell biology*, 24, 333-340.
4. Clark, M. B., Choudhary, A., Smith, M. A., Taft, R. J. and Mattick, J. S. (2013) The dark matter rises: the expanding world of regulatory RNAs. *Essays in biochemistry*, 54, 1-16.
5. Clerget, G., Abel, Y. and Rederstorff, M. (2015) Small non-coding RNAs: a quick look in the rearview mirror. *Methods in molecular biology*, 1296, 3-9.
6. Ha, M. and Kim, V. N. (2014) Regulation of microRNA biogenesis. *Nat Rev Mol Cell Biol*, 15, 509-524.
7. Winter, J., Jung, S., Keller, S., Gregory, R. I. and Diederichs, S. (2009) Many roads to maturity: microRNA biogenesis pathways and their regulation. *Nature cell biology*, 11, 228-234.
8. Bartel, D. P. (2004) MicroRNAs: genomics, biogenesis, mechanism, and function. *Cell*, 116, 281-297.
9. Bartel, D. P. (2009) MicroRNAs: target recognition and regulatory functions. *Cell*, 136, 215-233.
10. Schirle, N. T., Sheu-Gruttadauria, J. and MacRae, I. J. (2014) Structural basis for microRNA targeting. *Science*, 346, 608-613.
11. Lee, R. C., Feinbaum, R. L. and Ambros, V. (1993) The C. elegans heterochronic gene lin-4 encodes small RNAs with antisense complementarity to lin-14. *Cell*, 75, 843-854.
12. Reinhart, B. J., Slack, F. J., Basson, M., Pasquinelli, A. E., Bettinger, J. C., Rougvie, A. E., Horvitz, H. R. and Ruvkun, G. (2000) The 21-nucleotide let-7 RNA regulates developmental timing in Caenorhabditis elegans. *Nature*, 403, 901-906.
13. Sparks, E., Wachsman, G. and Benfey, P. N. (2013) Spatiotemporal signalling in plant development. *Nature reviews. Genetics*, 14, 631-644.
14. Dumortier, O., Fabris, G. and Van Obberghen, E. (2016) Shaping and preserving beta-cell identity with microRNAs. *Diabetes, obesity & metabolism*, 18 Suppl 1, 51-57.
15. Hilz, S., Modzelewski, A. J., Cohen, P. E. and Grimson, A. (2016) The roles of microRNAs and siRNAs in mammalian spermatogenesis. *Development*, 143, 3061-3073.
16. Edelstein, L. C., McKenzie, S. E., Shaw, C., Holinstat, M. A., Kunapuli, S. P. and Bray, P. F. (2013) MicroRNAs in platelet production and activation. *Journal of thrombosis and haemostasis: JTH*, 11 Suppl 1, 340-350.
17. Flowers, E., Won, G. Y. and Fukuoka, Y. (2015) MicroRNAs associated with exercise and diet: a systematic review. *Physiological genomics*, 47, 1-11.
18. Jeon, T. I. and Osborne, T. F. (2016) miRNA and cholesterol homeostasis. *Biochimica et biophysica acta*.
19. Mogilyansky, E. and Rigoutsos, I. (2013) The miR-17/92 cluster: a comprehensive update on its genomics, genetics, functions and increasingly important and numerous roles in health and disease. *Cell death and differentiation*, 20, 1603-1614.
20. Su, K., Zhang, T., Wang, Y. and Hao, G. (2016) Diagnostic and prognostic value of plasma microRNA-195 in patients with non-small cell lung cancer. *World journal of surgical oncology*, 14, 224.
21. Mehta, R., Otgonsuren, M., Younoszai, Z., Allawi, H., Raybuck, B. and Younossi, Z. (2016) Circulating miRNA in patients with non-alcoholic fatty liver disease and coronary artery disease. *BMJ open gastroenterology*, 3, e000096.
22. Calin, G. A. and Croce, C. M. (2006) MicroRNA signatures in human cancers. *Nature reviews. Cancer*, 6, 857-866.
23. Di Leva, G., Garofalo, M. and Croce, C. M. (2014) MicroRNAs in cancer. *Annual review of pathology*, 9, 287-314.
24. Backes, C., Kehl, T., Stockel, D., Fehlmann, T., Schneider, L., Meese, E., Lenhof, H. P. and Keller, A. (2016) miRPathDB: a new dictionary on microRNAs and target pathways. *Nucleic acids research*.
25. Cortez, M. A., Bueso-Ramos, C., Ferdin, J., Lopez-Berestein, G., Sood, A. K. and Calin, G. A. (2011) MicroRNAs in body fluids—the mix of hormones and biomarkers. *Nature reviews. Clinical oncology*, 8, 467-477.
26. Pimentel, F., Bonilla, P., Ravishankar, Y. G., Contag, A., Gopal, N., LaCour, S., Lee, T. and Niemz, A. (2015) Technology in MicroRNA Profiling: Circulating MicroRNAs as Noninvasive Cancer Biomarkers in Breast Cancer. *Journal of laboratory automation*, 20, 574-588.
27. Lu, J., Getz, G., Miska, E. A., Alvarez-Saavedra, E., Lamb, J., Peck, D., Sweet-Cordero, A., Ebert, B. L., Mak, R. H., Ferrando, A. A. et al. (2005) MicroRNA expression profiles classify human cancers. *Nature*, 435, 834-838.
28. Volinia, S., Calin, G. A., Liu, C. G., Ambs, S., Cimmino, A., Petrocca, F., Visone, R., Iorio, M., Roldo, C., Ferracin, M. et al. (2006) A microRNA expression signature of human solid tumors defines cancer gene targets. *Proceedings of the National Academy of Sciences of the United States of America*, 103, 2257-2261.

29. Rosenfeld, N., Aharonov, R., Meiri, E., Rosenwald, S., Spector, Y., Zepeniuk, M., Benjamin, H., Shabes, N., Tabak, S., Levy, A. et al. (2008) MicroRNAs accurately identify cancer tissue origin. *Nature biotechnology*, 26, 462-469.
30. Londin, E., Loher, P., Telonis, A. G., Quann, K., Clark, P., Jing, Y., Hatzimichael, E., Kirino, Y., Honda, S., Lally, M. et al. (2015) Analysis of 13 cell types reveals evidence for the expression of numerous novel primate- and tissue-specific microRNAs. *Proceedings of the National Academy of Sciences of the United States of America*.
31. Loher, P., Londin, E. R. and Rigoutsos, I. (2014) IsomiR Expression Profiles in Human Lymphoblastoid Cell Lines Exhibit Population and Gender Dependencies. *Oncotarget*, 5, 8790-8802.
32. Tan, G. C., Chan, E., Molnar, A., Sarkar, R., Alexieva, D., Isa, I. M., Robinson, S., Zhang, S., Ellis, P., Langford, C. F. et al. (2014) 5' isomiR variation is of functional and evolutionary importance. *Nucleic acids research*, 42, 9424-9435.
33. Wojcicka, A., Swierniak, M., Kornasiewicz, O., Gierlikowski, W., Maciag, M., Kolanowska, M., Kotlarek, M., Gornicka, B., Koperski, L., Niewinski, G. et al. (2014) Next generation sequencing reveals microRNA isoforms in liver cirrhosis and hepatocellular carcinoma. *The international journal of biochemistry & cell biology*, 53, 208-217.
34. Salem, O., Erdem, N., Jung, J., Munstermann, E., Worner, A., Wilhelm, H., Wiemann, S. and Korner, C. (2016) The highly expressed 5'isomiR of hsa-miR-140-3p contributes to the tumor-suppressive effects of miR-140 by reducing breast cancer proliferation and migration. *BMC genomics*, 17, 566.
35. Telonis, A. G., Loher, P., Jing, Y., Londin, E. and Rigoutsos, I. (2015) Beyond the one-locus-one-miRNA paradigm: microRNA isoforms enable deeper insights into breast cancer heterogeneity. *Nucleic acids research*, 43, 9158-9175.
36. Chu, A., Robertson, G., Brooks, D., Mungall, A. J., Birol, I., Coope, R., Ma, Y., Jones, S. and Marra, M. A. (2016) Large-scale profiling of microRNAs for The Cancer Genome Atlas. *Nucleic acids research*, 44, e3.
37. Landgraf, P., Rusu, M., Sheridan, R., Sewer, A., Iovino, N., Aravin, A., Pfeffer, S., Rice, A., Kamphorst, A. O., Landthaler, M. et al. (2007) A mammalian microRNA expression atlas based on small RNA library sequencing. *Cell*, 129, 1401-1414.
38. Shmulevich, I. and Zhang, W. (2002) Binary analysis and optimization-based normalization of gene expression data. *Bioinformatics*, 18, 555-565.
39. Tuna, S. and Niranjan, M. (2009) Classification with binary gene expressions. *Journal of Biomedical Science and Engineering*, 02, 390-399.
40. Zilliox, M. J. and Irizarry, R. A. (2007) A gene expression bar code for microarray data. *Nature methods*, 4, 911-913.
41. McHardy, A. C., Martin, H. G., Tsirigos, A., Hugenholtz, P. and Rigoutsos, I. (2007) Accurate phylogenetic classification of variable-length DNA fragments. *Nature methods*, 4, 63-72.
42. Warnecke, F., Luginbühl, P., Ivanova, N., Ghassemian, M., Richardson, T. H., Stege, J. T., Cayouette, M., McHardy, A. C., Djordjevic, G., Aboushadi, N. et al. (2007) Metagenomic and functional analysis of hindgut microbiota of a wood-feeding higher termite. *Nature*, 450, 560-565.
43. Noble, W. S. (2006) What is a support vector machine? *Nature biotechnology*, 24, 1565-1567.
44. Tsirigos, A. and Rigoutsos, I. (2005) A sensitive, support-vector-machine method for the detection of horizontal gene transfers in viral, archaeal and bacterial genomes. *Nucleic acids research*, 33, 3699-3707.
45. Yang, Z. R. (2004) Biological applications of support vector machines. *Briefings in bioinformatics*, 5, 328-338.
46. Cancer Genome Atlas, N. (2012) Comprehensive molecular characterization of human colon and rectal cancer. *Nature*, 487, 330-337.
47. Guyon, I., Weston, J., Barnhill, S. and Vapnik, V. (2002) *Machine Learning*, 46, 389-422.
48. Statnikov, A., Wang, L. and Aliferis, C. F. (2008) A comprehensive comparison of random forests and support vector machines for microarray-based cancer classification. *BMC bioinformatics*, 9, 319.
49. McCall, M. N., Jaffee, H. A., Zelisko, S. J., Sinha, N., Hooiveld, G., Irizarry, R. A. and Zilliox, M. J. (2014) The Gene Expression Barcode 3.0: improved data processing and mining tools. *Nucleic acids research*, 42, D938-943.
50. Yuva-Aydemir, Y., Simkin, A., Gascon, E. and Gao, F. B. (2011) MicroRNA-9: functional evolution of a conserved small regulatory RNA. *RNA biology*, 8, 557-564.
51. Coolen, M., Katz, S. and Bally-Cuif, L. (2013) miR-9: a versatile regulator of neurogenesis. *Frontiers in cellular neuroscience*, 7, 220.
52. Hudish, L. I., Galati, D. F., Ravanelli, A. M., Pearson, C. G., Huang, P. and Appel, B. (2016) miR-219 regulates neural progenitors by dampening apical Par protein-dependent Hedgehog signaling. *Development*, 143, 2292-2304.
53. Bandiera, S., Pfeffer, S., Baumert, T. F. and Zeisel, M. B. (2015) miR-122—a key factor and therapeutic target in liver disease. *Journal of hepatology*, 62, 448-457.
54. Gao, Z., Zhu, X. and Dou, Y. (2015) The miR-302/367 cluster: a comprehensive update on its evolution and functions. *Open biology*, 5, 150138.
55. Barroso-del Jesus, A., Lucena-Aguilar, G. and Menendez, P. (2009) The miR-302-367 cluster as a potential sternness regulator in ESCs. *Cell cycle*, 8, 394-398.
56. Schaefer, M. H. and Serrano, L. (2016) Cell type-specific properties and environment shape tissue specificity of cancer genes. *Scientific reports*, 6, 20707.
57. Shi, J. (2016) Considering Exosomal miR-21 as a Biomarker for Cancer. *Journal of clinical medicine*, 5.
58. Xin, H., Li, X., Yang, B., Zhang, L., Han, Z. and Han, C. (2014) Blood-based multiple-microRNA assay displays a better diagnostic performance than single-microRNA assay in the diagnosis of breast tumor. *Tumour biology: the journal of the International Society for Oncodevelopmental Biology and Medicine*, 35, 12635-12643.
59. Wang, Y., Liang, J., Di, C., Zhao, G. and Zhao, Y. (2014) Identification of miRNAs as potential new biomarkers for nervous system cancer. *Tumour biology: the journal of the International Society for Oncodevelopmental Biology and Medicine*, 35, 11631-11638.
60. Hornick, N. I., Huan, J., Doron, B., Goloviznina, N. A., Lapidus, J., Chang, B. H. and Kurre, P. (2015) Serum Exosome MicroRNA as a Minimally-Invasive Early Biomarker of AML. *Scientific reports*, 5, 11295.
61. Koppers-Lalic, D., Hackenberg, M., de Menezes, R., Misovic, B., Wachalska, M., Geldof, A., Zini, N., de Reijke, T., Wurdinger, T., Vis, A. et al. (2016) Noninvasive prostate cancer detection by measuring miRNA variants (isomiRs) in urine extracellular vesicles. *Oncotarget,* 7, 22566-22578.
62. Starega-Roslan, J., Witkos, T. M., Galka-Marciniak, P. and Krzyzosiak, W. J. (2015) Sequence features of Drosha and Dicer cleavage sites affect the complexity of isomiRs. *International journal of molecular sciences,* 16, 8110-8127.
63. Koppers-Lalic, D., Hackenberg, M., Bijnsdorp, I. V., van Eijndhoven, M. A., Sadek, P., Sie, D., Zini, N., Middeldorp, J. M., Ylstra, B., de Menezes, R. X. et al. (2014) Nontemplated nucleotide additions distinguish the small RNA composition in cells from exosomes. *Cell reports,* 8, 1649-1658.
64. Boele, J., Persson, H., Shin, J. W., Ishizu, Y., Newie, I. S., Sokilde, R., Hawkins, S. M., Coarfa, C., Ikeda, K., Takayama, K. et al. (2014) PAPD5-mediated 3' adenylation and subsequent degradation of miR-21 is disrupted in proliferative disease. *Proceedings of the National Academy of Sciences of the United States of America,* 111, 11467-11472.
65. Telonis A. G., Magee, R., Loher, P., Chervoneva, I., Londin, E., Rigoutsos, I. (2017) Knowledge about the presence or absence of miRNA isoforms (isomiRs) can successfully discriminate amongst 32 TCGA cancer types. *Nucleic Acids Res,* 45, 2973-2985.
66. Honda, S., Kirino, Y. (2015) Dumbbell-PCR: a method to quantify specific small RNA variants with a single nucleotide resolution at terminal sequences. *Nucleic Acids Res,* 43, e77.
67. Kumar, P., Johnston, B. H., Kazakov, S. A. (2011) miR-ID: a novel, circularization-based platform for detection of microRNAs. *RNA,* 17, 365-80.

Lengthy table referenced here

US11905563-20240220-T00001

Please refer to the end of the specification for access instructions.

Lengthy table referenced here

US11905563-20240220-T00002

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11905563B2). An electronic copy of the table will also be available from the USPTO upon request and payment of the fee set forth in 37 CFR 1.19(b)(3).

SEQUENCE LISTING (8595 sequences)

SEQ ID NO: 1 - DNA, 22 bp, Homo sapiens
tccttcattccaccggagtctg

SEQ ID NO: 2 - DNA, 23 bp, Homo sapiens
tccttcattccaccggagtctgt

SEQ ID NO: 3 - DNA, 21 bp, Homo sapiens
catcttccagtacagtgttgg

SEQ ID NO: 4 - DNA, 21 bp, Homo sapiens
tccttcattccaccggagtct

SEQ ID NO: 5 - DNA, 21 bp, Homo sapiens
taatactgccgggtaatgatg

SEQ ID NO: 6 - DNA, 22 bp, Homo sapiens
catcttccagtacagtgttgga

SEQ ID NO: 7 - DNA, 22 bp, Homo sapiens
taacactgtctggtaaagatgg

SEQ ID NO: 8 - DNA, 23 bp, Homo sapiens
taacactgtctggtaaagatggc

SEQ ID NO: 9 - DNA, 21 bp, Homo sapiens
taacactgtctggtaaagatg

SEQ ID NO: 10 - DNA, 23 bp, Homo sapiens
taatactgcctggtaatgatgac

SEQ ID NO: 11 - DNA, 21 bp, Homo sapiens
taatactgcctggtaatgatg

SEQ ID NO: 12 - DNA, 22 bp, Homo sapiens
taatactgtctggtaaaaccgt

SEQ ID NO: 13 - DNA, 22 bp, Homo sapiens
cgtcttacccagcagtgtttgg

SEQ ID NO: 14 - DNA, 23 bp, Homo sapiens
ttttgttcgttcggctcgcgtga

SEQ ID NO: 15 - DNA, 21 bp, Homo sapiens
tgacctatgaattgacagcca

SEQ ID NO: 16 - DNA, 22 bp, Homo sapiens
taggtagtttcatgttgttggg

SEQ ID NO: 17 - DNA, 21 bp, Homo sapiens
ttgttcgttcggctcgcgtga

SEQ ID NO: 18 - DNA, 23 bp, Homo sapiens
taacactgtctggtaacgatgtt

SEQ ID NO: 19 - DNA, 22 bp, Homo sapiens
taacactgtctggtaacgatgt

SEQ ID NO: 20 - DNA, 20 bp, Homo sapiens
tgacctatgaattgacagcc

SEQ ID NO: 21 - DNA, 23 bp, Homo sapiens
taggtagtttcctgttgttggga

SEQ ID NO: 22 - DNA, 22 bp, Homo sapiens
ttatggtttgcctgggactgag

SEQ ID NO: 23 - DNA, 21 bp, Homo sapiens
taggtagtttcatgttgttgg

SEQ ID NO: 24 - DNA, 22 bp, Homo sapiens
tatggcttttcattcctatgtg

SEQ ID NO: 25 - DNA, 19 bp, Homo sapiens
tttgttcgttcggctcgcg

SEQ ID NO: 26 - DNA, 20 bp, Homo sapiens
tttgttcgttcggctcgcgt

SEQ ID NO: 27 - DNA, 22 bp, Homo sapiens
aaattattgtacatcggatgag

SEQ ID NO: 28 - DNA, 22 bp, Homo sapiens
ttttgttcgttcggctcgcgtg

SEQ ID NO: 29 - DNA, 20 bp, Homo sapiens
ccctgtagatccgaatttgt

SEQ ID NO: 30 - DNA, 22 bp, Homo sapiens
ccagtggggctgctgttatctg

SEQ ID NO: 31 - DNA, 20 bp, Homo sapiens
taggtagtttcctgttgttg

SEQ ID NO: 32 - DNA, 22 bp, Homo sapiens
ctgccaattccataggtcacag

SEQ ID NO: 33 - DNA, 21 bp, Homo sapiens
tttgttcgttcggctcgcgtg

SEQ ID NO: 34 - DNA, 22 bp, Homo sapiens
acagattcgattctaggggaat

SEQ ID NO: 35 - DNA, 23 bp, Homo sapiens
tctggctccgtgtcttcactccc

SEQ ID NO: 36 - DNA, 23 bp, Homo sapiens
ctgacctatgaattgacagccag

SEQ ID NO: 37 - DNA, 22 bp, Homo sapiens
taggtagtttcctgttgttggg

SEQ ID NO: 38 - DNA, 21 bp, Homo sapiens
cgggaacgtcgagactggagc

SEQ ID NO: 39 - DNA, 23 bp, Homo sapiens
tatggcttttcattcctatgtga

SEQ ID NO: 40 - DNA, 22 bp, Homo sapiens
ccctgtagatccgaatttgtgt

SEQ ID NO: 41 - DNA, 18 bp, Homo sapiens
tgacctatgaattgacag

SEQ ID NO: 42 - DNA, 22 bp, Homo sapiens
taatactgccgggtaatgatgg

SEQ ID NO: 43 - DNA, 22 bp, Homo sapiens
tctggctccgtgtcttcactcc

SEQ ID NO: 44 - DNA, 20 bp, Homo sapiens
tccttcattccaccggagtc

SEQ ID NO: 45 - DNA, 22 bp, Homo sapiens
tccattacactaccctgcctct

SEQ ID NO: 46 - DNA, 21 bp, Homo sapiens
tctttggttatctagctgtat

SEQ ID NO: 47 - DNA, 23 bp, Homo sapiens
tgtgaaatgtttaggaccactag

SEQ ID NO: 48 - DNA, 22 bp, Homo sapiens
tgcaacgaacctgagccactga

SEQ ID NO: 49 - DNA, 20 bp, Homo sapiens
ttcagtcggatgtttgcagc

SEQ ID NO: 50 - DNA, 19 bp, Homo sapiens
ctgacctatgaattgacag

SEQ ID NO: 51 - DNA, 24 bp, Homo sapiens
taacactgtctggtaaagatggct

SEQ ID NO: 52 - DNA, 23 bp, Homo sapiens
aaaagtgcttacagtgcaggtag

SEQ ID NO: 53 - DNA, 19 bp, Homo sapiens
accctgtagaaccgaattt

SEQ ID NO: 54 - DNA, 19 bp, Homo sapiens
tccttcattccaccggagt

SEQ ID NO: 55 - DNA, 23 bp, Homo sapiens
taggtagtttcatgttgttggga

SEQ ID NO: 56 - DNA, 20 bp, Homo sapiens
ccctgtagaaccgaatttgt

SEQ ID NO: 57 - DNA, 21 bp, Homo sapiens
taatactgtctggtaaaaccg

SEQ ID NO: 58 - DNA, 18 bp, Homo sapiens
taccctgtagaaccgaat

SEQ ID NO: 59 - DNA, 21 bp, Homo sapiens
ccctgtagaaccgaatttgtg

SEQ ID NO: 60 - DNA, 21 bp, Homo sapiens
ccctgtagatccgaatttgtg

SEQ ID NO: 61 - DNA, 21 bp, Homo sapiens
ctttttgcggtctgggcttgc

SEQ ID NO: 62 - DNA, 20 bp, Homo sapiens
ttgttcgttcggctcgcgtg

SEQ ID NO: 63 - DNA, 22 bp, Homo sapiens
gtaaacatcctcgactggaagc

SEQ ID NO: 64 - DNA, 22 bp, Homo sapiens
caagtcactagtggttccgttt

SEQ ID NO: 65 - DNA, 21 bp, Homo sapiens
gtcatttttgtgatgttgcag

SEQ ID NO: 66 - DNA, 21 bp, Homo sapiens
atgacctatgaattgacagac

SEQ ID NO: 67 - DNA, 23 bp, Homo sapiens
tgtaacagcaactccatgtggaa

SEQ ID NO: 68 - DNA, 22 bp, Homo sapiens
ttccctttgtcatcctatgcct

SEQ ID NO: 69 - DNA, 24 bp, Homo sapiens
ctgacctatgaattgacagccagt

SEQ ID NO: 70 - DNA, 22 bp, Homo sapiens
catcttactgggcagcattgga

SEQ ID NO: 71 - DNA, 22 bp, Homo sapiens
cccagtgtttagactatctgtt

SEQ ID NO: 72 - DNA, 22 bp, Homo sapiens
aattgcacggtatccatctgta

SEQ ID NO: 73 - DNA, 21 bp, Homo sapiens
tttttcattattgctcctgac

SEQ ID NO: 74 - DNA, 22 bp, Homo sapiens
accgatttctcctggtgttcag

SEQ ID NO: 75 - DNA, 18 bp, Homo sapiens
ctttcagtcggatgtttg

SEQ ID NO: 76 - DNA, 23 bp, Homo sapiens
ctttcagtcggatgtttgcagct

SEQ ID NO: 77 - DNA, 23 bp, Homo sapiens
ataccctgtagaaccgaatttgt

SEQ ID NO: 78 - DNA, 19 bp, Homo sapiens
taccctgtagaaccgaatt

SEQ ID NO: 79 - DNA, 23 bp, Homo sapiens
ctgtaacagcaactccatgtgga

SEQ ID NO: 80 - DNA, 27 bp, Homo sapiens
tttggcaatggtagaactcacactggt

SEQ ID NO: 81 - DNA, 19 bp, Homo sapiens
taccctgtagatccgaatt

SEQ ID NO: 82 - DNA, 22 bp, Homo sapiens
ctggtttcacatggtggcttag

SEQ ID NO: 83 - DNA, 23 bp, Homo sapiens
taaggtgcatctagtgcagatag

SEQ ID NO: 84 - DNA, 18 bp, Homo sapiens
taccctgtagatccgaat

SEQ ID NO: 85 - DNA, 23 bp, Homo sapiens
tatggctttttattcctatgtga

SEQ ID NO: 86 - DNA, 22 bp, Homo sapiens
atgacctatgaattgacagaca

SEQ ID NO: 87 - DNA, 17 bp, Homo sapiens
gatgaagcactgtagct

SEQ ID NO: 88 - DNA, 20 bp, Homo sapiens
ttttgttcgttcggctcgcg

SEQ ID NO: 89 - DNA, 22 bp, Homo sapiens
tggagtgtgacaatggtgtttg

SEQ ID NO: 90 - DNA, 22 bp, Homo sapiens
tggaatgtaaagaagtatgtat

SEQ ID NO: 91 - DNA, 21 bp, Homo sapiens
atcttaccggacagtgctgga

SEQ ID NO: 92 - DNA, 23 bp, Homo sapiens
ctaatactgccgggtaatgatgg

SEQ ID NO: 93 - DNA, 22 bp, Homo sapiens
aaccactgaccgttgactgtac

SEQ ID NO: 94 - DNA, 22 bp, Homo sapiens
tggaatgtaaggaagtgtgtgg

SEQ ID NO: 95 - DNA, 22 bp, Homo sapiens
aacaccagtcgatgggctgtct

SEQ ID NO: 96 - DNA, 23 bp, Homo sapiens
tagcaccatttgaaatcggttat

SEQ ID NO: 97 - DNA, 23 bp, Homo sapiens
tttgttcgttcggctcgcgtgag

SEQ ID NO: 98 - DNA, 20 bp, Homo sapiens
aaagttctgagacactccga

SEQ ID NO: 99 - DNA, 19 bp, Homo sapiens
ctgtaaacgctttctgatg

SEQ ID NO: 100 - DNA, 22 bp, Homo sapiens
ggattcctggaaatactgttct

SEQ ID NO: 101 - DNA, 22 bp, Homo sapiens
ctgtaacagcaactccatgtgg

SEQ ID NO: 102 - DNA, 22 bp, Homo sapiens
ataccctgtagatccgaatttg

SEQ ID NO: 103 - DNA, 22 bp, Homo sapiens
ctgccctggcccgagggaccga

SEQ ID NO: 104 - DNA, 22 bp, Homo sapiens
tgcctgtctacacttgctgtgc

SEQ ID NO: 105 - DNA, 22 bp, Homo sapiens
tatggctttttattcctatgtg

SEQ ID NO: 106 - DNA, 22 bp, Homo sapiens
aaagttctgagacactccgact

SEQ ID NO: 107 - DNA, 23 bp, Homo sapiens
gtttttcattattgctcctgacc

SEQ ID NO: 108 - DNA, 22 bp, Homo sapiens
attgcacttgtcccggcctgtt

SEQ ID NO: 109 - DNA, 22 bp, Homo sapiens
acccgtcccgttcgtccccgga

SEQ ID NO: 110 - DNA, 21 bp, Homo sapiens
ttttgttcgttcggctcgcgt

SEQ ID NO: 111 - DNA, 22 bp, Homo sapiens
acattcaacgctgtcggtgagt

SEQ ID NO: 112 - DNA, 19 bp, Homo sapiens
caatggtagaactcacact

SEQ ID NO: 113 - DNA, 21 bp, Homo sapiens
catcttactgggcagcattgg

SEQ ID NO: 114 - DNA, 20 bp, Homo sapiens
ctgagatgaagcactgtagc

SEQ ID NO: 115 - DNA, 23 bp, Homo sapiens
tacagtagtctgcacattggtta

SEQ ID NO: 116 - DNA, 22 bp, Homo sapiens
aaacccgtagatccgatcttgt

SEQ ID NO: 117 - DNA, 22 bp, Homo sapiens
aactggttgaacaactgaaccc

SEQ ID NO: 118 - DNA, 23 bp, Homo sapiens
ctgagatgaagcactgtagctca

SEQ ID NO: 119 - DNA, 18 bp, Homo sapiens
ctgacctatgaattgaca

SEQ ID NO: 120 - DNA, 24 bp, Homo sapiens
caagtcactagtggttccgtttag

SEQ ID NO: 121 - DNA, 23 bp, Homo sapiens
tgacctatgaattgacagccagt

SEQ ID NO: 122 - DNA, 23 bp, Homo sapiens
ttccctttgtcatcctatgcctg

SEQ ID NO: 123 - DNA, 18 bp, Homo sapiens
ctgtagatccgaatttgt

SEQ ID NO: 124 - DNA, 19 bp, Homo sapiens
tgggtctttgcgggcgaga

SEQ ID NO: 125 - DNA, 23 bp, Homo sapiens
agctacatctggctactgggtct

SEQ ID NO: 126 - DNA, 21 bp, Homo sapiens
tggagtgtgacaatggtgttt

SEQ ID NO: 127 - DNA, 20 bp, Homo sapiens
tctggctccgtgtcttcact

SEQ ID NO: 128 - DNA, 18 bp, Homo sapiens
accctgtagatccgaatt

SEQ ID NO: 129 - DNA, 21 bp, Homo sapiens
ctgtgcgtgtgacagcggctg

SEQ ID NO: 130 - DNA, 21 bp, Homo sapiens
aactggccctcaaagtcccgc

SEQ ID NO: 131 - DNA, 22 bp, Homo sapiens
ctgtacaaccttctagctttcc

SEQ ID NO: 132 - DNA, 22 bp, Homo sapiens
acaagtcaggctcttgggacct

SEQ ID NO: 133 - DNA, 22 bp, Homo sapiens
agctacatctggctactgggtc

SEQ ID NO: 134 - DNA, 22 bp, Homo sapiens
tcacattgccagggatttccaa

SEQ ID NO: 135 - DNA, 21 bp, Homo sapiens
acattcaacgctgtcggtgag

SEQ ID NO: 136 - DNA, 20 bp, Homo sapiens
tttttcattattgctcctga

SEQ ID NO: 137 - DNA, 20 bp, Homo sapiens
taatactgccgggtaatgat

SEQ ID NO: 138 - DNA, 21 bp, Homo sapiens
ttgaggtagtaggttgtatgg

SEQ ID NO: 139 - DNA, 21 bp, Homo sapiens
taatgcccctaaaaatcctta

SEQ ID NO: 140 - DNA, 22 bp, Homo sapiens
gtagataaaatattggtacctg

SEQ ID NO: 141 - DNA, 19 bp, Homo sapiens
gatgaagcactgtagctca

SEQ ID NO: 142 - DNA, 23 bp, Homo sapiens
ataccctgtagatccgaatttgt

SEQ ID NO: 143 - DNA, 20 bp, Homo sapiens
tattgcactcgtcccggcct

SEQ ID NO: 144 - DNA, 17 bp, Homo sapiens
caacaccagtcgatggg

SEQ ID NO: 145 - DNA, 22 bp, Homo sapiens
agcagcattgtacagggctatc

SEQ ID NO: 146 - DNA, 20 bp, Homo sapiens
ctgtgcgtgtgacagcggct

SEQ ID NO: 147 - DNA, 22 bp, Homo sapiens
tgtttaaccttttgcctgttgg

SEQ ID NO: 148 - DNA, 22 bp, Homo sapiens
aacggaatcccaaaagcagctg

SEQ ID NO: 149 - DNA, 21 bp, Homo sapiens
ctagcaccatttgaaatcagt

SEQ ID NO: 150 - DNA, 23 bp, Homo sapiens
cccagtgtttagactatctgttc

SEQ ID NO: 151 - DNA, 23 bp, Homo sapiens
tcaggctcagtcccctcccgata

SEQ ID NO: 152 - DNA, 24 bp, Homo sapiens
aactgtttgcagaggaaactgaga

SEQ ID NO: 153 - DNA, 21 bp, Homo sapiens
tgtcagtttgtcaaatacccc

SEQ ID NO: 154 - DNA, 19 bp, Homo sapiens
cagtagtctgcacattggt

SEQ ID NO: 155 - DNA, 20 bp, Homo sapiens
ctagcaccatttgaaatcag

SEQ ID NO: 156 - DNA, 21 bp, Homo sapiens
ttccctttgtcatcctatgcc

SEQ ID NO: 157 - DNA, 21 bp, Homo sapiens
tatacgacctgctgcctttct

SEQ ID NO: 158 - DNA, 23 bp, Homo sapiens
ctgccctggcccgagggaccgac

SEQ ID NO: 159 - DNA, 22 bp, Homo sapiens
actctttccctgttgcactact

SEQ ID NO: 160 - DNA, 22 bp, Homo sapiens
agagcttagctgattggtgaac

SEQ ID NO: 161 - DNA, 22 bp, Homo sapiens
gctgactcctagtccagggctc

SEQ ID NO: 162 - DNA, 23 bp, Homo sapiens
aaggagcttacaatctagctggg

SEQ ID NO: 163 - DNA, 21 bp, Homo sapiens
tgtttgcagaggaaactgaga

SEQ ID NO: 164 - DNA, 22 bp, Homo sapiens
ttgaggtagtaggttgtatggt

SEQ ID NO: 165 - DNA, 21 bp, Homo sapiens
actagactgtgagcttctaga

SEQ ID NO: 166 - DNA, 23 bp, Homo sapiens
ctggtttcacatggtggcttaga

SEQ ID NO: 167 - DNA, 24 bp, Homo sapiens
tgaggtagtaggttgtatagtttt

SEQ ID NO: 168 - DNA, 23 bp, Homo sapiens
gtaaacatcctcgactggaagct

SEQ ID NO: 169 - DNA, 19 bp, Homo sapiens
gagatgaagcactgtagct

SEQ ID NO: 170 - DNA, 20 bp, Homo sapiens
taacactgtctggtaaagat

SEQ ID NO: 171 - DNA, 19 bp, Homo sapiens
taacactgtctggtaaaga

SEQ ID NO: 172 - DNA, 21 bp, Homo sapiens
cgaatcattatttgctgctct

SEQ ID NO: 173 - DNA, 21 bp, Homo sapiens
catcttaccggacagtgctgg

SEQ ID NO: 174 - DNA, 22 bp, Homo sapiens
catcttaccggacagtgctgga

SEQ ID NO: 175 - DNA, 22 bp, Homo sapiens
taatactgcctggtaatgatga

SEQ ID NO: 176 - DNA, 21 bp, Homo sapiens
taacactgtctggtaacgatg

SEQ ID NO: 177 - DNA, 23 bp, Homo sapiens
tgagaactgaattccatgggttg

SEQ ID NO: 178 - DNA, 19 bp, Homo sapiens
accctgtagatccgaattt

SEQ ID NO: 179 - DNA, 22 bp, Homo sapiens
ctaatactgccgggtaatgatg

SEQ ID NO: 180 - DNA, 23 bp, Homo sapiens
ttatggtttgcctgggactgagg

SEQ ID NO: 181 - DNA, 20 bp, Homo sapiens
actgtaaacgctttctgatg

SEQ ID NO: 182 - DNA, 22 bp, Homo sapiens
agggcttagctgcttgtgagca

SEQ ID NO: 183 - DNA, 19 bp, Homo sapiens
atggcactggtagaattca

SEQ ID NO: 184 - DNA, 22 bp, Homo sapiens
ttccctttgtcatccttcgcct

SEQ ID NO: 185 - DNA, 19 bp, Homo sapiens
gcattgtacagggctatga

SEQ ID NO: 186 - DNA, 22 bp, Homo sapiens
cgaatcattatttgctgctcta

SEQ ID NO: 187 - DNA, 22 bp, Homo sapiens
ctgtatgccctcaccgctcagc

SEQ ID NO: 188 - DNA, 19 bp, Homo sapiens
tttcagtcggatgtttgca

SEQ ID NO: 189 - DNA, 22 bp, Homo sapiens
tttccggctcgcgtgggtgtgt

SEQ ID NO: 190 - DNA, 22 bp, Homo sapiens
ctttggttatctagctgtatga

SEQ ID NO: 191 - DNA, 20 bp, Homo sapiens
atggcactggtagaattcac

SEQ ID NO: 192 - DNA, 22 bp, Homo sapiens
tcagcaccaggatattgttgga

SEQ ID NO: 193 - DNA, 20 bp, Homo sapiens
gtgaaatgtttaggaccact

SEQ ID NO: 194 - DNA, 22 bp, Homo sapiens
tactgcatcaggaactgattgg

SEQ ID NO: 195 - DNA, 20 bp, Homo sapiens
ttccctttgtcatccttcgc

SEQ ID NO: 196 - DNA, 22 bp, Homo sapiens
tcgtgtcttgtgttgcagccgg

SEQ ID NO: 197 - DNA, 24 bp, Homo sapiens
caaagtgcttacagtgcaggtagt

SEQ ID NO: 198 - DNA, 21 bp, Homo sapiens
tattgcactcgtcccggcctc

SEQ ID NO: 199 - DNA, 20 bp, Homo sapiens
gtgcattgtagttgcattgc

SEQ ID NO: 200 - DNA, 20 bp, Homo sapiens
ccatgttgccagtctctagg

SEQ ID NO: 201 - DNA, 21 bp, Homo sapiens
gtgaaatgtttaggaccacta

SEQ ID NO: 202 - DNA, 23 bp, Homo sapiens
ttccctttgtcatccttcgccta

SEQ ID NO: 203 - DNA, 21 bp, Homo sapiens
tccagcatcagtgattttgtt

SEQ ID NO: 204 - DNA, 24 bp, Homo sapiens
agctacatctggctactgggtctc

SEQ ID NO: 205 - DNA, 24 bp, Homo sapiens
tatggcactggtagaattcactgt

SEQ ID NO: 206 - DNA, 21 bp, Homo sapiens
actggacttggagtcagaaga

SEQ ID NO: 207 - DNA, 21 bp, Homo sapiens
cccataaagtagaaagcacta

SEQ ID NO: 208 - DNA, 21 bp, Homo sapiens
ctagattgtgagctcctggag

SEQ ID NO: 209 - DNA, 23 bp, Homo sapiens
tctacagtgcacgtgtctccagt

SEQ ID NO: 210 - DNA, 20 bp, Homo sapiens
tgctggatcagtggttcgag

SEQ ID NO: 211 - DNA, 21 bp, Homo sapiens
cagtgcactacagaactttgt

SEQ ID NO: 212 - DNA, 22 bp, Homo sapiens
ttgtgtcaatatgcgatgatgt

SEQ ID NO: 213 - DNA, 21 bp, Homo sapiens
gccctgtggactcagttctgg

SEQ ID NO: 214 - DNA, 20 bp, Homo sapiens
tattgcacttgtcccggcct

SEQ ID NO: 215 - DNA, 23 bp, Homo sapiens
accactgaccgttgactgtacct

SEQ ID NO: 216 - DNA, 20 bp, Homo sapiens
tgtaaacatcctacactcag

SEQ ID NO: 217 - DNA, 23 bp, Homo sapiens
tcacattgccagggatttccaac

SEQ ID NO: 218 - DNA, 21 bp, Homo sapiens
tggcagtgtcttagctggttg

SEQ ID NO: 219 - DNA, 23 bp, Homo sapiens
gtgaaatgtttaggaccactaga

SEQ ID NO: 220 - DNA, 23 bp, Homo sapiens
gactatagaactttccccctcat

SEQ ID NO: 221 - DNA, 21 bp, Homo sapiens
tggagacgcggccctgttgga

SEQ ID NO: 222 - DNA, 25 bp, Homo sapiens
agctacatctggctactgggtctct

SEQ ID NO: 223 - DNA, 23 bp, Homo sapiens
actgcagtgaaggcacttgtagc

SEQ ID NO: 224 - DNA, 23 bp, Homo sapiens
caactagactgtgagcttctaga

SEQ ID NO: 225 - DNA, 20 bp, Homo sapiens
agctacattgtctgctgggt

SEQ ID NO: 226 - DNA, 20 bp, Homo sapiens
gcttatcagactgatgttga

SEQ ID NO: 227 - DNA, 19 bp, Homo sapiens
accactgaccgttgactgt

SEQ ID NO: 228 - DNA, 16 bp, Homo sapiens
taccctgtagaaccga

SEQ ID NO: 229 - DNA, 20 bp, Homo sapiens
cagcagcaattcatgttttg

SEQ ID NO: 230 - DNA, 20 bp, Homo sapiens
tcacattgccagggatttcc

SEQ ID NO: 231 - DNA, 20 bp, Homo sapiens
catcttaccggacagtgctg

SEQ ID NO: 232 - DNA, 22 bp, Homo sapiens
ctagcaccatttgaaatcggtt

SEQ ID NO: 233 - DNA, 21 bp, Homo sapiens
attgcacttgtctcggtctga

SEQ ID NO: 234 - DNA, 20 bp, Homo sapiens
agtgctgttcgtgcaggtag

SEQ ID NO: 235 - DNA, 23 bp, Homo sapiens
tcgaggagctcacagtctagtat

SEQ ID NO: 236 - DNA, 23 bp, Homo sapiens
gtgaggtagtaggttgtatagtt

SEQ ID NO: 237 - DNA, 23 bp, Homo sapiens
ctgaggtagtagtttgtacagtt

SEQ ID NO: 238 - DNA, 21 bp, Homo sapiens
cagtgcaatgttaaaagggca

SEQ ID NO: 239 - DNA, 23 bp, Homo sapiens
acagtagtctgcacattggttag

SEQ ID NO: 240 - DNA, 21 bp, Homo sapiens
aacaatatcctggtgctgagt

SEQ ID NO: 241 - DNA, 19 bp, Homo sapiens
ttcacagtggctaagttct

SEQ ID NO: 242 - DNA, 19 bp, Homo sapiens
agctacattgtctgctggg

SEQ ID NO: 243 - DNA, 23 bp, Homo sapiens
tgggtttacgttgggagaacttt

SEQ ID NO: 244 - DNA, 22 bp, Homo sapiens
actccagccccacagcctcagc

SEQ ID NO: 245 - DNA, 23 bp, Homo sapiens
ttcaccaccttctccacccagca

SEQ ID NO: 246 - DNA, 21 bp, Homo sapiens
tctggctccgtgtcttcactc

SEQ ID NO: 247 - DNA, 22 bp, Homo sapiens
ctatacaatctactgtctttcc

SEQ ID NO: 248 - DNA, 22 bp, Homo sapiens
aactgtttgcagaggaaactga

SEQ ID NO: 249 - DNA, 20 bp, Homo sapiens
tacagtagtctgcacattgg

SEQ ID NO: 250 - DNA, 22 bp, Homo sapiens
ctggactgagccgtgctactgg

SEQ ID NO: 251 - DNA, 23 bp, Homo sapiens
catcttaccggacagtgctggat

SEQ ID NO: 252 - DNA, 20 bp, Homo sapiens
cccagtgttcagactacctg

SEQ ID NO: 253 - DNA, 20 bp, Homo sapiens
acccgtagatccgaacttgt

SEQ ID NO: 254 - DNA, 21 bp, Homo sapiens
tgcggggctagggctaacagc

SEQ ID NO: 255 - DNA, 24 bp, Homo sapiens
cccccaggtgtgattctgatttgc

SEQ ID NO: 256 - DNA, 21 bp, Homo sapiens
gtcagtttgtcaaatacccca

SEQ ID NO: 257 - DNA, 23 bp, Homo sapiens
caaagtgctcatagtgcaggtag

SEQ ID NO: 258 - DNA, 20 bp, Homo sapiens
aacattcaacgctgtcggtg

SEQ ID NO: 259 - DNA, 23 bp, Homo sapiens
aaagctgggttgagagggcgaaa

SEQ ID NO: 260 - DNA, 20 bp, Homo sapiens
tgtcagtttgtcaaataccc

SEQ ID NO: 261 - DNA, 20 bp, Homo sapiens
tagcagcacatcatggttta

SEQ ID NO: 262 - DNA, 22 bp, Homo sapiens
aaagtgcttacagtgcaggtag

SEQ ID NO: 263 - DNA, 21 bp, Homo sapiens
cccagtgttcagactacctgt

SEQ ID NO: 264 - DNA, 18 bp, Homo sapiens
ttatcagactgatgttga

SEQ ID NO: 265 - DNA, 21 bp, Homo sapiens
tattgcacattactaagttgc

SEQ ID NO: 266 - DNA, 22 bp, Homo sapiens
agcttatcagactgatgttgac

SEQ ID NO: 267 - DNA, 23 bp, Homo sapiens
ggcttctttacagtgctgccttg

SEQ ID NO: 268 - DNA, 22 bp, Homo sapiens
ttgaaacaatctctactgaacc

SEQ ID NO: 269 - DNA, 21 bp, Homo sapiens
tgaaatgtttaggaccactag

SEQ ID NO: 270 - DNA, 20 bp, Homo sapiens
accatcgaccgttgattgta

SEQ ID NO: 271 - DNA, 19 bp, Homo sapiens
accatcgaccgttgattgt

SEQ ID NO: 272 - DNA, 19 bp, Homo sapiens
caacaccagtcgatgggct

SEQ ID NO: 273 - DNA, 19 bp, Homo sapiens
gcagtccatgggcatatac

SEQ ID NO: 274 - DNA, 19 bp, Homo sapiens
ctagcaccatctgaaatcg

SEQ ID NO: 275 - DNA, 18 bp, Homo sapiens
tttgttcgttcggctcgc

SEQ ID NO: 276 - DNA, 19 bp, Homo sapiens
aacccgtagatccgaactt

SEQ ID NO: 277 - DNA, 20 bp, Homo sapiens
taatgcccctaaaaatcctt

SEQ ID NO: 278 - DNA, 20 bp, Homo sapiens
accctgtagaaccgaatttg

SEQ ID NO: 279 - DNA, 21 bp, Homo sapiens
actctagctgccaaaggcgct

SEQ ID NO: 280 - DNA, 20 bp, Homo sapiens
tccctgagaccctttaacct

SEQ ID NO: 281 - DNA, 21 bp, Homo sapiens
ttttgcaatatgttcctgaat

SEQ ID NO: 282 - DNA, 21 bp, Homo sapiens
agctacatctggctactgggt

SEQ ID NO: 283 - DNA, 20 bp, Homo sapiens
taccctgtagatccgaattt

SEQ ID NO: 284 - DNA, 18 bp, Homo sapiens
accctgtagaaccgaatt

SEQ ID NO: 285 - DNA, 23 bp, Homo sapiens
ttgaggtagtaggttgtatggtt

SEQ ID NO: 286 - DNA, 22 bp, Homo sapiens
tgagaaccacgtctgctctgag

SEQ ID NO: 287 - DNA, 23 bp, Homo sapiens
aactgtttgcagaggaaactgag

SEQ ID NO: 288 - DNA, 21 bp, Homo sapiens
gtgaggtagtaggttgtatag

SEQ ID NO: 289 - DNA, 24 bp, Homo sapiens
tgtcagtttgtcaaataccccaag

SEQ ID NO: 290 - DNA, 23 bp, Homo sapiens
ctgtgcgtgtgacagcggctgat

SEQ ID NO: 291 - DNA, 23 bp, Homo sapiens
actgtgcgtgtgacagcggctga

SEQ ID NO: 292 - DNA, 20 bp, Homo sapiens
aacccgtagatccgatcttg

SEQ ID NO: 293 - DNA, 21 bp, Homo sapiens
taggtagtttcctgttgttgg

SEQ ID NO: 294 - DNA, 19 bp, Homo sapiens
tattgcactcgtcccggcc

SEQ ID NO: 295 - DNA, 22 bp, Homo sapiens
agctcggtctgaggcccctcag

SEQ ID NO: 296 - DNA, 24 bp, Homo sapiens
atgacacgatcactcccgttgagt

SEQ ID NO: 297 - DNA, 22 bp, Homo sapiens
aatgcacccgggcaaggattct

SEQ ID NO: 298 - DNA, 23 bp, Homo sapiens
taagtgcttccatgttttagtag

SEQ ID NO: 299 - DNA, 19 bp, Homo sapiens
tgacctatgaattgacagc

SEQ ID NO: 300 - DNA, 20 bp, Homo sapiens
tcacattgccagggattacc

SEQ ID NO: 301 - DNA, 22 bp, Homo sapiens
tacgtcatcgttgtcatcgtca

SEQ ID NO: 302 - DNA, 18 bp, Homo sapiens
taatactgccgggtaatg

SEQ ID NO: 303 - DNA, 21 bp, Homo sapiens
ttgtgcttgatctaaccatgt

SEQ ID NO: 304 - DNA, 21 bp, Homo sapiens
acaagtcaggctcttgggacc

SEQ ID NO: 305 - DNA, 19 bp, Homo sapiens
acagtagtctgcacattgg

SEQ ID NO: 306 - DNA, 22 bp, Homo sapiens
agaattgtggctggacatctgt

SEQ ID NO: 307 - DNA, 23 bp, Homo sapiens
ctgaagctcagagggctctgatt

SEQ ID NO: 308 - DNA, 23 bp, Homo sapiens
tttggcactagcacatttttgct

SEQ ID NO: 309 - DNA, 23 bp, Homo sapiens
tggagtgtgacaatggtgtttgt

SEQ ID NO: 310 - DNA, 16 bp, Homo sapiens
taccctgtagatccga

SEQ ID NO: 311 - DNA, 23 bp, Homo sapiens
tgtgacagattgataactgaaag

SEQ ID NO: 312 - DNA, 23 bp, Homo sapiens
gtagtgtttcctactttatggat

SEQ ID NO: 313 - DNA, 19 bp, Homo sapiens
tacagtactgtgataactg

SEQ ID NO: 314 - DNA, 23 bp, Homo sapiens
tggctcagttcagcaggaacagg

SEQ ID NO: 315 - DNA, 23 bp, Homo sapiens
agctacattgtctgctgggtttc

SEQ ID NO: 316 - DNA, 21 bp, Homo sapiens
ataccctgtagatccgaattt

SEQ ID NO: 317 - DNA, 21 bp, Homo sapiens
aactggttgaacaactgaacc

SEQ ID NO: 318 - DNA, 21 bp, Homo sapiens
tatacaagggcaagctctctg

SEQ ID NO: 319 - DNA, 19 bp, Homo sapiens
tgaaatgtttaggaccact

SEQ ID NO: 320 - DNA, 22 bp, Homo sapiens
aaggagcttacaatctagctgg

SEQ ID NO: 321 - DNA, 22 bp, Homo sapiens
caactagactgtgagcttctag

SEQ ID NO: 322 - DNA, 18 bp, Homo sapiens
tttggcaatggtagaact

SEQ ID NO: 323 - DNA, 22 bp, Homo sapiens
ttataaagcaatgagactgatt

SEQ ID NO: 324 - DNA, 20 bp, Homo sapiens
gactatagaactttccccct

SEQ ID NO: 325 - DNA, 22 bp, Homo sapiens
ttggtccccttcaaccagctgt

SEQ ID NO: 326 - DNA, 22 bp, Homo sapiens
atcttaccggacagtgctggat

SEQ ID NO: 327 - DNA, 23 bp, Homo sapiens
aggcagtgtagttagctgattgc

SEQ ID NO: 328 - DNA, 20 bp, Homo sapiens
agtgcttacagtgcaggtag

SEQ ID NO: 329 - DNA, 21 bp, Homo sapiens
aactagactgtgagcttctag

SEQ ID NO: 330 - DNA, 22 bp, Homo sapiens
gtcagtttgtcaaataccccaa

SEQ ID NO: 331 - DNA, 21 bp, Homo sapiens
tttggttatctagctgtatga

SEQ ID NO: 332 - DNA, 17 bp, Homo sapiens
tgagatgaagcactgta

SEQ ID NO: 333 - DNA, 22 bp, Homo sapiens
actcggcgtggcgtcggtcgtg

SEQ ID NO: 334 - DNA, 21 bp, Homo sapiens
gtaaacatcctcgactggaag

SEQ ID NO: 335 - DNA, 21 bp, Homo sapiens
tgagaactgaattccataggc

SEQ ID NO: 336 - DNA, 23 bp, Homo sapiens
aacccgtagatccgaacttgtgg

SEQ ID NO: 337 - DNA, 20 bp, Homo sapiens
attcctggaaatactgttct

SEQ ID NO: 338 - DNA, 22 bp, Homo sapiens
atgacacgatcactcccgttga

SEQ ID NO: 339 - DNA, 23 bp, Homo sapiens
agcagcattgtacagggctatca

SEQ ID NO: 340 - DNA, 22 bp, Homo sapiens
ccctgtagaaccgaatttgtgt

SEQ ID NO: 341 - DNA, 19 bp, Homo sapiens
cttatcagactgatgttga

SEQ ID NO: 342 - DNA, 22 bp, Homo sapiens
ttataatacaacctgataagtg

SEQ ID NO: 343 - DNA, 19 bp, Homo sapiens
tcagtgcactacagaactt

SEQ ID NO: 344 - DNA, 24 bp, Homo sapiens
gtagcttatcagactgatgttgac

SEQ ID NO: 345 - DNA, 23 bp, Homo sapiens
taaagctagataaccgaaagtag

SEQ ID NO: 346 - DNA, 22 bp, Homo sapiens
ctcgtaccgtgagtaataatgc

SEQ ID NO: 347 - DNA, 20 bp, Homo sapiens
tattgcacattactaagttg

SEQ ID NO: 348 - DNA, 20 bp, Homo sapiens
taatactgcctggtaatgat

SEQ ID NO: 349 - DNA, 23 bp, Homo sapiens
atgacacgatcactcccgttgag

SEQ ID NO: 350 - DNA, 19 bp, Homo sapiens
ttcagtcggatgtttgcag

SEQ ID NO: 351 - DNA, 21 bp, Homo sapiens
gaggtagtaggttgtatagtt

SEQ ID NO: 352 - DNA, 23 bp, Homo sapiens
ttgtgacagattgataactgaaa

SEQ ID NO: 353 - DNA, 21 bp, Homo sapiens
ctggactgagccgtgctactg

SEQ ID NO: 354 - DNA, 22 bp, Homo sapiens
ccacagggtagaaccacggaca

SEQ ID NO: 355 - DNA, 20 bp, Homo sapiens
ctggactgagccgtgctact

SEQ ID NO: 356 - DNA, 23 bp, Homo sapiens
taactggttgaacaactgaaccc

SEQ ID NO: 357 - DNA, 21 bp, Homo sapiens
gtgtcttttgctctgcagtca

SEQ ID NO: 358 - DNA, 23 bp, Homo sapiens
tgctatgccaacatattgccatc

SEQ ID NO: 359 - DNA, 22 bp, Homo sapiens
ccgcactgtgggtacttgctgc

SEQ ID NO: 360 - DNA, 20 bp, Homo sapiens
ctttttgcggtctgggcttg

SEQ ID NO: 361 - DNA, 23 bp, Homo sapiens
ttcaagtaattcaggataggttg

SEQ ID NO: 362 - DNA, 23 bp, Homo sapiens
attctaatttctccacgtctttg

SEQ ID NO: 363 - DNA, 21 bp, Homo sapiens
attcctggaaatactgttctt

SEQ ID NO: 364 - DNA, 23 bp, Homo sapiens
tcagcaccaggatattgttggag

SEQ ID NO: 365 - DNA, 21 bp, Homo sapiens
ctgccaattccataggtcaca

SEQ ID NO: 366 - DNA, 21 bp, Homo sapiens
ctcggcgtggcgtcggtcgtg

SEQ ID NO: 367 - DNA, 21 bp, Homo sapiens
gcttatcagactgatgttgac

SEQ ID NO: 368 - DNA, 20 bp, Homo sapiens
ctgcgcaagctactgccttg

SEQ ID NO: 369 - DNA, 19 bp, Homo sapiens
tctttggttatctagctgt

SEQ ID NO: 370 - DNA, 23 bp, Homo sapiens
tcacacagaaatcgcacccgtca

SEQ ID NO: 371 - DNA, 19 bp, Homo sapiens
tgtcagtttgtcaaatacc

SEQ ID NO: 372 - DNA, 20 bp, Homo sapiens
ctatacgacctgctgccttt

SEQ ID NO: 373 - DNA, 21 bp, Homo sapiens
ctgcgcaagctactgccttgc

SEQ ID NO: 374 - DNA, 22 bp, Homo sapiens
aatgacacgatcactcccgttg

SEQ ID NO: 375 - DNA, 22 bp, Homo sapiens
ccactgccccaggtgctgctgg

SEQ ID NO: 376 - DNA, 21 bp, Homo sapiens
aattgcacggtatccatctgt

SEQ ID NO: 377 - DNA, 21 bp, Homo sapiens
caactagactgtgagcttcta

SEQ ID NO: 378 - DNA, 19 bp, Homo sapiens
ctgccagttgaagaactgt

SEQ ID NO: 379 - DNA, 23 bp, Homo sapiens
aggcaagatgctggcatagctgt

SEQ ID NO: 380 - DNA, 21 bp, Homo sapiens
gctgactcctagtccagggct

SEQ ID NO: 381 - DNA, 21 bp, Homo sapiens
gcccctgggcctatcctagaa

SEQ ID NO: 382 - DNA, 19 bp, Homo sapiens
taactggttgaacaactga

SEQ ID NO: 383 - DNA, 20 bp, Homo sapiens
cgtaccgtgagtaataatgc

SEQ ID NO: 384 - DNA, 23 bp, Homo sapiens
cacccgtagaaccgaccttgcgg

SEQ ID NO: 385 - DNA, 23 bp, Homo sapiens
tttggtccccttcaaccagctgt

SEQ ID NO: 386 - DNA, 22 bp, Homo sapiens
ctgcgcaagctactgccttgct

SEQ ID NO: 387 - DNA, 21 bp, Homo sapiens
caaagtgcttacagtgcaggt

SEQ ID NO: 388 - DNA, 22 bp, Homo sapiens
tctacagtgcacgtgtctccag

SEQ ID NO: 389 - DNA, 23 bp, Homo sapiens
tcgtgtcttgtgttgcagccgga

SEQ ID NO: 390 - DNA, 22 bp, Homo sapiens
tgtatggcactggtagaattca

SEQ ID NO: 391 - DNA, 22 bp, Homo sapiens
cccataaagtagaaagcactac

SEQ ID NO: 392 - DNA, 21 bp, Homo sapiens
cctcccacacccaaggcttgc

SEQ ID NO: 393 - DNA, 22 bp, Homo sapiens
ctgtttgcagaggaaactgaga

SEQ ID NO: 394 - DNA, 20 bp, Homo sapiens
aacattcattgctgtcggtg

SEQ ID NO: 395 - DNA, 22 bp, Homo sapiens
ttgtgacagattgataactgaa

SEQ ID NO: 396 - DNA, 21 bp, Homo sapiens
tagataaaatattggtacctg

SEQ ID NO: 397 - DNA, 23 bp, Homo sapiens
tgagaaccacgtctgctctgagc

SEQ ID NO: 398 - DNA, 20 bp, Homo sapiens
tttggttatctagctgtatg

SEQ ID NO: 399 - DNA, 22 bp, Homo sapiens
tttggttatctagctgtatgag

SEQ ID NO: 400 - DNA, 20 bp, Homo sapiens
caagctcgtgtctgtgggtc

SEQ ID NO: 401 - DNA, 22 bp, Homo sapiens
gaagttgttcgtggtggattcg

SEQ ID NO: 402 - DNA, 22 bp, Homo sapiens
aggcaagatgctggcatagctg

SEQ ID NO: 403 - DNA, 21 bp, Homo sapiens
tatggcttttcattcctatgt

SEQ ID NO: 404 - DNA, 20 bp, Homo sapiens
tctttggttatctagctgta

SEQ ID NO: 405 - DNA, 22 bp, Homo sapiens
aatggcgccactagggttgtgc

SEQ ID NO: 406 - DNA, 22 bp, Homo sapiens
aactggcctacaaagtcccagt

SEQ ID NO: 407 - DNA, 23 bp, Homo sapiens
tgcaccatggttgtctgagcatg

SEQ ID NO: 408 - DNA, 22 bp, Homo sapiens
gagcttattcataaaagtgcag

SEQ ID NO: 409 - DNA, 23 bp, Homo sapiens
cctcagggctgtagaacagggct

SEQ ID NO: 410 - DNA, 20 bp, Homo sapiens
tcgtaccgtgagtaataatg

SEQ ID NO: 411 - DNA, 20 bp, Homo sapiens
ggctgtaccaccttgtcggg

SEQ ID NO: 412 - DNA, 22 bp, Homo sapiens
tcaaatgctcagactcctgtgg

SEQ ID NO: 413 - DNA, 23 bp, Homo sapiens
tcaaatgctcagactcctgtggt

SEQ ID NO: 414 - DNA, 21 bp, Homo sapiens
actagactgaagctccttgag

SEQ ID NO: 415 - DNA, 21 bp, Homo sapiens
atggcactggtagaattcact

SEQ ID NO: 416 - DNA, 22 bp, Homo sapiens
tcacattgccagggattaccac

SEQ ID NO: 417 - DNA, 22 bp, Homo sapiens
tttggcactagcacatttttgc

SEQ ID NO: 418 - DNA, 21 bp, Homo sapiens
ctgttgccactaacctcaacc

SEQ ID NO: 419 - DNA, 21 bp, Homo sapiens
cccagtgtttagactatctgt

SEQ ID NO: 420 - DNA, 23 bp, Homo sapiens
gtgtcagtttgtcaaatacccca

SEQ ID NO: 421 - DNA, 22 bp, Homo sapiens
caaagtgcttacagtgcaggta

SEQ ID NO: 422 - DNA, 21 bp, Homo sapiens
tgaggggcagagagcgagact

SEQ ID NO: 423 - DNA, 20 bp, Homo sapiens
taactggttgaacaactgaa

SEQ ID NO: 424 - DNA, 21 bp, Homo sapiens
tatggcactggtagaattcac

SEQ ID NO: 425 - DNA, 20 bp, Homo sapiens
ctttggttatctagctgtat

SEQ ID NO: 426 - DNA, 19 bp, Homo sapiens
atcacattgccagggatta

SEQ ID NO: 427 - DNA, 16 bp, Homo sapiens
caacaccagtcgatgg

SEQ ID NO: 428 - DNA, 21 bp, Homo sapiens
tggcactggtagaattcactg

SEQ ID NO: 429 - DNA, 24 bp, Homo sapiens
caaagaattctccttttgggcttt

SEQ ID NO: 430 - DNA, 17 bp, Homo sapiens
gtaatccaggataggct

SEQ ID NO: 431 - DNA, 21 bp, Homo sapiens
taaagctagataaccgaaagt

SEQ ID NO: 432 - DNA, 22 bp, Homo sapiens
gttcacagtggctaagttctgc

SEQ ID NO: 433 - DNA, 24 bp, Homo sapiens
taccctgtagatccgaatttgtgt

SEQ ID NO: 434 - DNA, 20 bp, Homo sapiens
cccataaagtagaaagcact

SEQ ID NO: 435 - DNA, 22 bp, Homo sapiens
ataaagctagataaccgaaagt

SEQ ID NO: 436 - DNA, 22 bp, Homo sapiens
acattcattgctgtcggtgggt

SEQ ID NO: 437 - DNA, 20 bp, Homo sapiens
ttggttatctagctgtatga

SEQ ID NO: 438 - DNA, 20 bp, Homo sapiens
agcttatcagactgatgttg

SEQ ID NO: 439 - DNA, 24 bp, Homo sapiens
gtccagttttcccaggaatccctt

SEQ ID NO: 440 - DNA, 23 bp, Homo sapiens
tgtgcaaatctatgcaaaactga

SEQ ID NO: 441 - DNA, 19 bp, Homo sapiens
cgtaccgtgagtaataatg

SEQ ID NO: 442 - DNA, 22 bp, Homo sapiens
cagtgcaatgatgaaagggcat

SEQ ID NO: 443 - DNA, 24 bp, Homo sapiens
tgcaccatggttgtctgagcatgc

SEQ ID NO: 444 - DNA, 22 bp, Homo sapiens
tttggtccccttcaaccagctg

SEQ ID NO: 445 - DNA, 20 bp, Homo sapiens
tatgtctgctgaccatcacc

SEQ ID NO: 446 - DNA, 20 bp, Homo sapiens
ccgcactgtgggtacttgct

SEQ ID NO: 447 - DNA, 20 bp, Homo sapiens
ttccctttgtcatcctatgc

SEQ ID NO: 448 - DNA, 21 bp, Homo sapiens
tagcagcacagaaatattggc

SEQ ID NO: 449 - DNA, 15 bp, Homo sapiens
accctgtagatccga

SEQ ID NO: 450 - DNA, 20 bp, Homo sapiens
tggagtgtgacaatggtgtt

SEQ ID NO: 451 - DNA, 22 bp, Homo sapiens
tgcggggctagggctaacagca

SEQ ID NO: 452 - DNA, 23 bp, Homo sapiens
caacaccagtcgatgggctgtct

SEQ ID NO: 453 - DNA, 24 bp, Homo sapiens
tacagtagtctgcacattggttag

SEQ ID NO: 454 - DNA, 21 bp, Homo sapiens
ggctcagttcagcaggaacag

SEQ ID NO: 455 - DNA, 21 bp, Homo sapiens
ttattgcttaagaatacgcgt

SEQ ID NO: 456 - DNA, 21 bp, Homo sapiens
tgtgactggttgaccagaggg

SEQ ID NO: 457 - DNA, 23 bp, Homo sapiens
tgattgtagccttttggagtaga

SEQ ID NO: 458 - DNA, 22 bp, Homo sapiens
tgattgtagccttttggagtag

SEQ ID NO: 459 - DNA, 22 bp, Homo sapiens
tgattggtacgtctgtgggtag

SEQ ID NO: 460 - DNA, 23 bp, Homo sapiens
tgattggtacgtctgtgggtaga

SEQ ID NO: 461 - DNA, 24 bp, Homo sapiens
tgagaactgaattccatgggttgt

SEQ ID NO: 462 - DNA, 22 bp, Homo sapiens
tgaaatgtttaggaccactaga

SEQ ID NO: 463 - DNA, 23 bp, Homo sapiens
tgattgacacttctgtgagtaga

SEQ ID NO: 464 - DNA, 21 bp, Homo sapiens
tgagaactgaattccatgggt

SEQ ID NO: 465 - DNA, 19 bp, Homo sapiens
tatggcactggtagaattc

SEQ ID NO: 466 - DNA, 22 bp, Homo sapiens
ttgagaactgaattccatgggt

SEQ ID NO: 467 - DNA, 21 bp, Homo sapiens
ctggccctctctgcccttccg

SEQ ID NO: 468 - DNA, 24 bp, Homo sapiens
tattgcacttgtcccggcctgttg

SEQ ID NO: 469 - DNA, 22 bp, Homo sapiens
tattcatttatccccagcctac

SEQ ID NO: 470 - DNA, 22 bp, Homo sapiens
tggacggagaactgataagggt

SEQ ID NO: 471 - DNA, 22 bp, Homo sapiens
tgtgcaaatctatgcaaaactg

SEQ ID NO: 472 - DNA, 22 bp, Homo sapiens
agttttgcaggtttgcatccag

SEQ ID NO: 473 - DNA, 24 bp, Homo sapiens
taatactgccgggtaatgatggag

SEQ ID NO: 474 - DNA, 27 bp, Homo sapiens
tagcttatcagactgatgttgactgtt

SEQ ID NO: 475 - DNA, 23 bp, Homo sapiens
cactggacttggagtcagaaggc

SEQ ID NO: 476 - DNA, 23 bp, Homo sapiens
tagcagcgggaacagttctgcag

SEQ ID NO: 477 - DNA, 23 bp, Homo sapiens
ttgagaactgaattccatgggtt

SEQ ID NO: 478 - DNA, 20 bp, Homo sapiens
ctcactgaacaatgaatgca

SEQ ID NO: 479 - DNA, 20 bp, Homo sapiens
gctgccagttgaagaactgt

SEQ ID NO: 480 - DNA, 22 bp, Homo sapiens
tatgtgcctttggactacatcg

SEQ ID NO: 481 - DNA, 18 bp, Homo sapiens
tttcagtcggatgtttgc

SEQ ID NO: 482 - DNA, 22 bp, Homo sapiens
ccagtattaactgtgctgctga

SEQ ID NO: 483 - DNA, 23 bp, Homo sapiens
tactgcatcaggaactgattgga

SEQ ID NO: 484 - DNA, 20 bp, Homo sapiens
agctacatctggctactggg

SEQ ID NO: 485 - DNA, 23 bp, Homo sapiens
caagctcgtgtctgtgggtccgt

SEQ ID NO: 486 - DNA, 22 bp, Homo sapiens
cctgttctccattacttggctc

SEQ ID NO: 487 - DNA, 21 bp, Homo sapiens
attgacacttctgtgagtaga

SEQ ID NO: 488 - DNA, 24 bp, Homo sapiens
ctaatactgccgggtaatgatgga

SEQ ID NO: 489 - DNA, 22 bp, Homo sapiens
tgccctgtggactcagttctgg

SEQ ID NO: 490 - DNA, 22 bp, Homo sapiens
cactggacttggagtcagaagg

SEQ ID NO: 491 - DNA, 21 bp, Homo sapiens
ctcactgaacaatgaatgcaa

SEQ ID NO: 492 - DNA, 20 bp, Homo sapiens
ctgtgcctggcctgaggagc

SEQ ID NO: 493 - DNA, 19 bp, Homo sapiens
ttccctttgtcatccttcg

SEQ ID NO: 494 - DNA, 21 bp, Homo sapiens
agggccccccctcaatcctgt

SEQ ID NO: 495 - DNA, 22 bp, Homo sapiens
aaagctgggttgagagggcgaa

SEQ ID NO: 496 - DNA, 20 bp, Homo sapiens
acccgtagaaccgaccttgc

SEQ ID NO: 497 - DNA, 20 bp, Homo sapiens
tgcggggctagggctaacag

SEQ ID NO: 498 - DNA, 22 bp, Homo sapiens
aagctcggtctgaggcccctca

SEQ ID NO: 499 - DNA, 22 bp, Homo sapiens
tcaagagcaataacgaaaaatg

SEQ ID NO: 500 - DNA, 24 bp, Homo sapiens
aatccttggaacctaggtgtgagt

SEQ ID NO: 501 - DNA, 22 bp, Homo sapiens
ctccgtttgcctgtttcgctga

SEQ ID NO: 502 - DNA, 22 bp, Homo sapiens
ctgcattatgagcacttaaagt

SEQ ID NO: 503 - DNA, 20 bp, Homo sapiens
tgtaaacatcctacactctc

SEQ ID NO: 504 - DNA, 23 bp, Homo sapiens
tgtctcccaacccttgtaccagt

SEQ ID NO: 505 - DNA, 25 bp, Homo sapiens
aatgacacgatcactcccgttgagt

SEQ ID NO: 506 - DNA, 19 bp, Homo sapiens
tagcagcacatcatggttt

SEQ ID NO: 507 - DNA, 23 bp, Homo sapiens
aatccttggaacctaggtgtgag

SEQ ID NO: 508 - DNA, 19 bp, Homo sapiens
ggtagtaggttgtatagtt

SEQ ID NO: 509 - DNA, 19 bp, Homo sapiens
cataaagtagaaagcacta

SEQ ID NO: 510 - DNA, 21 bp, Homo sapiens
aaagctgggttgagagggcga

SEQ ID NO: 511 - DNA, 19 bp, Homo sapiens
tttggcaatggtagaactc

SEQ ID NO: 512 - DNA, 22 bp, Homo sapiens
actgctgagctagcacttcccg

SEQ ID NO: 513 - DNA, 20 bp, Homo sapiens
tccagcatcagtgattttgt

SEQ ID NO: 514 - DNA, 24 bp, Homo sapiens
tgaggtaggaggttgtatagttga

SEQ ID NO: 515 - DNA, 21 bp, Homo sapiens
attgtagccttttggagtaga

SEQ ID NO: 516 - DNA, 22 bp, Homo sapiens
ctgagatgaagcactgtagctc

SEQ ID NO: 517 - DNA, 22 bp, Homo sapiens
cgtcaacacttgctggtttcct

SEQ ID NO: 518 - DNA, 25 bp, Homo sapiens
aacattcaacgctgtcggtgagttt

SEQ ID NO: 519 - DNA, 19 bp, Homo sapiens
ctgagatgaagcactgtag

SEQ ID NO: 520 - DNA, 26 bp, Homo sapiens
tagcttatcagactgatgttgactgt

SEQ ID NO: 521 - DNA, 21 bp, Homo sapiens
caagctcgtgtctgtgggtcc

SEQ ID NO: 522 - DNA, 18 bp, Homo sapiens
tgaggtagtagattgtat

SEQ ID NO: 523 - DNA, 22 bp, Homo sapiens
cagcagcacactgtggtttgta

SEQ ID NO: 524 - DNA, 23 bp, Homo sapiens
ctagcaccatttgaaatcagtgt

SEQ ID NO: 525 - DNA, 20 bp, Homo sapiens
ttaatgctaatcgtgatagg

SEQ ID NO: 526 - DNA, 21 bp, Homo sapiens
gtgcattgtagttgcattgca

SEQ ID NO: 527 - DNA, 19 bp, Homo sapiens
tccctgagaccctaacttg

SEQ ID NO: 528 - DNA, 22 bp, Homo sapiens
gagaactgaattccatgggttg

SEQ ID NO: 529 - DNA, 23 bp, Homo sapiens
cccccaggtgtgattctgatttg

SEQ ID NO: 530 - DNA, 22 bp, Homo sapiens
tgttgtacttttttttttgttc

SEQ ID NO: 531 - DNA, 21 bp, Homo sapiens
ctatacaatctactgtctttc

SEQ ID NO: 532 - DNA, 19 bp, Homo sapiens
gctgtaccaccttgtcggg

SEQ ID NO: 533 - DNA, 20 bp, Homo sapiens
cactagattgtgagctcctg

SEQ ID NO: 534 - DNA, 23 bp, Homo sapiens
tgaggtagtaagttgtattgttg

SEQ ID NO: 535 - DNA, 21 bp, Homo sapiens
tgctggatcagtggttcgagt

SEQ ID NO: 536 - DNA, 17 bp, Homo sapiens
tgtaccaccttgtcggg

SEQ ID NO: 537 - DNA, 18 bp, Homo sapiens
tagcaccatctgaaatcg

SEQ ID NO: 538 - DNA, 21 bp, Homo sapiens
agctcggtctgaggcccctca

SEQ ID NO: 539 - DNA, 22 bp, Homo sapiens
accaatattactgtgctgcttt

SEQ ID NO: 540 - DNA, 22 bp, Homo sapiens
agtgtttcctactttatggatg

SEQ ID NO: 541 - DNA, 22 bp, Homo sapiens
attctaatttctccacgtcttt

SEQ ID NO: 542 - DNA, 22 bp, Homo sapiens
ctgggagaaggctgtttactct

SEQ ID NO: 543 - DNA, 24 bp, Homo sapiens
taaagtgcttatagtgcaggtagt

SEQ ID NO: 544 - DNA, 21 bp, Homo sapiens
aaccactgaccgttgactgta

SEQ ID NO: 545 - DNA, 22 bp, Homo sapiens
caacaaatcacagtctgccata

SEQ ID NO: 546 - DNA, 21 bp, Homo sapiens
cataaagtagaaagcactact

SEQ ID NO: 547 - DNA, 22 bp, Homo sapiens
ttgtgcttgatctaaccatgtg

SEQ ID NO: 548 - DNA, 21 bp, Homo sapiens
taacagtctacagccatggtc

SEQ ID NO: 549 - DNA, 21 bp, Homo sapiens
tgtagtgtttcctactttatg

SEQ ID NO: 550 - DNA, 22 bp, Homo sapiens
actgatttcttttggtgttcag

SEQ ID NO: 551 - DNA, 22 bp, Homo sapiens
gctttcagtcggatgtttacag

SEQ ID NO: 552 - DNA, 21 bp, Homo sapiens
tcacattgccagggatttcca

SEQ ID NO: 553 - DNA, 23 bp, Homo sapiens
aggttgggatcggttgcaatgct

SEQ ID NO: 554 - DNA, 22 bp, Homo sapiens
aacattcaacctgtcggtgagt

SEQ ID NO: 555 - DNA, 22 bp, Homo sapiens
cactcctctcctcccgtcttct

SEQ ID NO: 556 - DNA, 22 bp, Homo sapiens
agttcttcagtggcaagcttta

SEQ ID NO: 557 - DNA, 22 bp, Homo sapiens
aagacgggaggaaagaagggag

SEQ ID NO: 558 - DNA, 22 bp, Homo sapiens
aacattcattgttgtcggtggg

SEQ ID NO: 559 - DNA, 20 bp, Homo sapiens
cataaagtagaaagcactac

SEQ ID NO: 560 - DNA, 25 bp, Homo sapiens
aacattcattgctgtcggtgggttt

SEQ ID NO: 561 - DNA, 23 bp, Homo sapiens
ttgtgcttgatctaaccatgtgg

SEQ ID NO: 562 - DNA, 23 bp, Homo sapiens
tgccctgtggactcagttctggt

SEQ ID NO: 563 - DNA, 23 bp, Homo sapiens
cagtgcaatagtattgtcaaagc

SEQ ID NO: 564 - DNA, 19 bp, Homo sapiens
tgaggtagtagattgtata

SEQ ID NO: 565 - DNA, 21 bp, Homo sapiens
taccgcactgtgggtacttgc

SEQ ID NO: 566 - DNA, 20 bp, Homo sapiens
gcccctgggcctatcctaga

SEQ ID NO: 567 - DNA, 21 bp, Homo sapiens
agttcttcagtggcaagcttt

SEQ ID NO: 568 - DNA, 20 bp, Homo sapiens
ttgcacttgtcccggcctgt

SEQ ID NO: 569 - DNA, 22 bp, Homo sapiens
tgtctcccaacccttgtaccag

SEQ ID NO: 570 - DNA, 25 bp, Homo sapiens
ttaatgctaatcgtgataggggttt

SEQ ID NO: 571 - DNA, 19 bp, Homo sapiens
agctacatctggctactgg

SEQ ID NO: 572 - DNA, 20 bp, Homo sapiens
tgggtctttgcgggcgagat

SEQ ID NO: 573 - DNA, 21 bp, Homo sapiens
aatgacacgatcactcccgtt

SEQ ID NO: 574 - DNA, 24 bp, Homo sapiens
acagtagtctgcacattggttaga

SEQ ID NO: 575 - DNA, 20 bp, Homo sapiens
gtagtgtttcctactttatg

SEQ ID NO: 576 - DNA, 22 bp, Homo sapiens
ctatacggcctcctagctttcc

SEQ ID NO: 577 - DNA, 23 bp, Homo sapiens
aatgcacctgggcaaggattctg

SEQ ID NO: 578 - DNA, 21 bp, Homo sapiens
tctctgggcctgtgtcttagg

SEQ ID NO: 579 - DNA, 21 bp, Homo sapiens
ccacagggtagaaccacggac

SEQ ID NO: 580 - DNA, 22 bp, Homo sapiens
atgctgacatatttactagagg

SEQ ID NO: 581 - DNA, 23 bp, Homo sapiens
gtcaacacttgctggtttcctct

SEQ ID NO: 582 - DNA, 22 bp, Homo sapiens
accgcactgtgggtacttgctg

SEQ ID NO: 583 - DNA, 22 bp, Homo sapiens
taccgcactgtgggtacttgct

SEQ ID NO: 584 - DNA, 23 bp, Homo sapiens
tgagatgaagcactgtagctcag

SEQ ID NO: 585 - DNA, 24 bp, Homo sapiens
ctgccctggcccgagggaccgact

SEQ ID NO: 586 - DNA, 19 bp, Homo sapiens
aagctgccagttgaagaac

SEQ ID NO: 587 - DNA, 16 bp, Homo sapiens
aagctgccagttgaag

SEQ ID NO: 588 - DNA, 20 bp, Homo sapiens
tcctgtactgagctgccccg

SEQ ID NO: 589 - DNA, 23 bp, Homo sapiens
ctttcagtcggatgtttacagcg

SEQ ID NO: 590 - DNA, 21 bp, Homo sapiens
ttataatacaacctgataagt

SEQ ID NO: 591 - DNA, 22 bp, Homo sapiens
gtagcttatcagactgatgttg

SEQ ID NO: 592 - DNA, 24 bp, Homo sapiens
cgtcaacacttgctggtttcctct

SEQ ID NO: 593 - DNA, 21 bp, Homo sapiens
tcccccaggtgtgattctgat

SEQ ID NO: 594 - DNA, 21 bp, Homo sapiens
ctttggttatctagctgtatg

SEQ ID NO: 595 - DNA, 20 bp, Homo sapiens
cattattacttttggtacgc

SEQ ID NO: 596 - DNA, 23 bp, Homo sapiens
aagacgggaggaaagaagggagt

SEQ ID NO: 597 - DNA, 23 bp, Homo sapiens
tggaagactagtgattttgttgt

SEQ ID NO: 598 - DNA, 24 bp, Homo sapiens
tgaggggcagagagcgagactttt

SEQ ID NO: 599 - DNA, 20 bp, Homo sapiens
ctatacaatctactgtcttt

SEQ ID NO: 600 - DNA, 22 bp, Homo sapiens
gcagcattgtacagggctatga

SEQ ID NO: 601 - DNA, 22 bp, Homo sapiens
actagactgaagctccttgagg

SEQ ID NO: 602 - DNA, 23 bp, Homo sapiens
actgctgagctagcacttcccga

SEQ ID NO: 603 - DNA, 24 bp, Homo sapiens
aaaagctgggttgagagggcgaaa

SEQ ID NO: 604 - DNA, 18 bp, Homo sapiens
atcacattgccagggatt

SEQ ID NO: 605 - DNA, 23 bp, Homo sapiens
cattgcacttgtctcggtctgac

SEQ ID NO: 606 - DNA, 21 bp, Homo sapiens
acattcattgctgtcggtggg

SEQ ID NO: 607 - DNA, 18 bp, Homo sapiens
tgaggtagtaggttgtgt

SEQ ID NO: 608 - DNA, 21 bp, Homo sapiens
caaagttctgagacactccga

SEQ ID NO: 609 - DNA, 21 bp, Homo sapiens
ccctgagaccctaacttgtga

SEQ ID NO: 610 - DNA, 21 bp, Homo sapiens
aagacgggaggaaagaaggga

SEQ ID NO: 611 - DNA, 22 bp, Homo sapiens
atccccagatacaatggacaat

SEQ ID NO: 612 - DNA, 21 bp, Homo sapiens
tgagacctctgggttctgagc

SEQ ID NO: 613 - DNA, 23 bp, Homo sapiens
caccttgcgctactcaggtctgc

SEQ ID NO: 614 - DNA, 23 bp, Homo sapiens
tcgaccggacctcgaccggctcg

SEQ ID NO: 615 - DNA, 18 bp, Homo sapiens
cacccgtagaaccgacct

SEQ ID NO: 616 - DNA, 18 bp, Homo sapiens
atgttgccagtctctagg

SEQ ID NO: 617 - DNA, 25 bp, Homo sapiens
aaaccgttaccattactgagtttag

SEQ ID NO: 618 - DNA, 22 bp, Homo sapiens
tagcagcacagaaatattggca

SEQ ID NO: 619 - DNA, 22 bp, Homo sapiens
tgctggatcagtggttcgagtc

SEQ ID NO: 620 - DNA, 21 bp, Homo sapiens
ggtgcagtgctgcatctctgg

SEQ ID NO: 621 - DNA, 21 bp, Homo sapiens
actatagaactttccccctca

SEQ ID NO: 622 - DNA, 24 bp, Homo sapiens
aagcagcattgtacagggctatga

SEQ ID NO: 623 - DNA, 22 bp, Homo sapiens
tgagacctctgggttctgagct

SEQ ID NO: 624 - DNA, 23 bp, Homo sapiens
gtgaggactcgggaggtggaggg

SEQ ID NO: 625 - DNA, 21 bp, Homo sapiens
tggagagaaaggcagttcctg

SEQ ID NO: 626 - DNA, 22 bp, Homo sapiens
cccagtgttcagactacctgtt

SEQ ID NO: 627 - DNA, 21 bp, Homo sapiens
ctcctgactccaggtcctgtg

SEQ ID NO: 628 - DNA, 24 bp, Homo sapiens
tgttcctctgtctcccagactctg

SEQ ID NO: 629 - DNA, 20 bp, Homo sapiens
tgaggtagtagtttgtacag

SEQ ID NO: 630 - DNA, 22 bp, Homo sapiens
ctgaagctcagagggctctgat

SEQ ID NO: 631 - DNA, 20 bp, Homo sapiens
tccctgagaccctaacttgt

SEQ ID NO: 632 - DNA, 21 bp, Homo sapiens
cagcagcacactgtggtttgt

SEQ ID NO: 633 - DNA, 23 bp, Homo sapiens
cagtgcaatgttaaaagggcatt

SEQ ID NO: 634 - DNA, 23 bp, Homo sapiens
aacattcattgttgtcggtgggt

SEQ ID NO: 635 - DNA, 20 bp, Homo sapiens
aaccgttaccattactgagt

SEQ ID NO: 636 - DNA, 20 bp, Homo sapiens
atcacattgccagggattac

SEQ ID NO: 637 - DNA, 25 bp, Homo sapiens
agcagcattgtacagggctatgaaa

SEQ ID NO: 638 - DNA, 22 bp, Homo sapiens
aactagactgtgagcttctaga

SEQ ID NO: 639 - DNA, 22 bp, Homo sapiens
taatgcccctaaaaatccttat

SEQ ID NO: 640 - DNA, 19 bp, Homo sapiens
tgtaaacatcctcgactgg

SEQ ID NO: 641 - DNA, 20 bp, Homo sapiens
tcggatccgtctgagcttgg

SEQ ID NO: 642 - DNA, 23 bp, Homo sapiens
agaggtagtaggttgcatagttt

SEQ ID NO: 643 - DNA, 20 bp, Homo sapiens
actagattgtgagctcctgg

SEQ ID NO: 644 - DNA, 20 bp, Homo sapiens
tgggtttacgttgggagaac

SEQ ID NO: 645 - DNA, 23 bp, Homo sapiens
catcttccagtacagtgttggat

SEQ ID NO: 646 - DNA, 20 bp, Homo sapiens
cagtgcactacagaactttg

SEQ ID NO: 647 - DNA, 20 bp, Homo sapiens
tgtgactggttgaccagagg

SEQ ID NO: 648 - DNA, 23 bp, Homo sapiens
gggagccaggaagtattgatgtt

SEQ ID NO: 649 - DNA, 23 bp, Homo sapiens
cgcatcccctagggcattggtgt

SEQ ID NO: 650 - DNA, 23 bp, Homo sapiens
aacattcaacctgtcggtgagtt

SEQ ID NO: 651 - DNA, 20 bp, Homo sapiens
caacaccagtcgatgggctg

SEQ ID NO: 652 - DNA, 20 bp, Homo sapiens
tcagtgcactacagaacttt

SEQ ID NO: 653 - DNA, 21 bp, Homo sapiens
cacgctcatgcacacacccac

SEQ ID NO: 654 - DNA, 24 bp, Homo sapiens
aagctcggtctgaggcccctcagt

SEQ ID NO: 655 - DNA, 19 bp, Homo sapiens
caagctcgtgtctgtgggt

SEQ ID NO: 656 - DNA, 21 bp, Homo sapiens
ctatacaacctactgccttcc

SEQ ID NO: 657 - DNA, 21 bp, Homo sapiens
actcggcgtggcgtcggtcgt

SEQ ID NO: 658 - DNA, 20 bp, Homo sapiens
ttatcagaatctccaggggt

SEQ ID NO: 659 - DNA, 20 bp, Homo sapiens
gtccagttttcccaggaatc

SEQ ID NO: 660 - DNA, 21 bp, Homo sapiens
tgcaacgaacctgagccactg

SEQ ID NO: 661 - DNA, 22 bp, Homo sapiens
ttagggccctggctccatctcc

SEQ ID NO: 662 - DNA, 20 bp, Homo sapiens
gtacagtactgtgataactg

SEQ ID NO: 663 - DNA, 21 bp, Homo sapiens
tacagtagtctgcacattggt

SEQ ID NO: 664 - DNA, 19 bp, Homo sapiens
tagcaccatttgaaatcag

SEQ ID NO: 665 - DNA, 21 bp, Homo sapiens
accatgttgccagtctctagg

SEQ ID NO: 666 - DNA, 22 bp, Homo sapiens
ctcctacatattagcattaaca

SEQ ID NO: 667 - DNA, 22 bp, Homo sapiens
tagcaccatttgaaatcagtgt

SEQ ID NO: 668 - DNA, 19 bp, Homo sapiens
gtaaacatccttgactgga

SEQ ID NO: 669 - DNA, 20 bp, Homo sapiens
actagactgaagctccttga

SEQ ID NO: 670 - DNA, 23 bp, Homo sapiens
atggcactggtagaattcactgt

SEQ ID NO: 671 - DNA, 21 bp, Homo sapiens
aacattcaacctgtcggtgag

SEQ ID NO: 672 - DNA, 20 bp, Homo sapiens
accctgtagatccgaatttg

SEQ ID NO: 673 - DNA, 21 bp, Homo sapiens
tcacattgccagggattacca

SEQ ID NO: 674 - DNA, 22 bp, Homo sapiens
aactggccctcaaagtcccgct

SEQ ID NO: 675 - DNA, 22 bp, Homo sapiens
cgcatcccctagggcattggtg

SEQ ID NO: 676 - DNA, 22 bp, Homo sapiens
taaagtgcttatagtgcaggta

SEQ ID NO: 677 - DNA, 23 bp, Homo sapiens
tgaggtagtagattgtatagttg

SEQ ID NO: 678 - DNA, 22 bp, Homo sapiens
ctctagccacagatgcagtgat

SEQ ID NO: 679 - DNA, 22 bp, Homo sapiens
ctagcaccatttgaaatcagtg

SEQ ID NO: 680 - DNA, 15 bp, Homo sapiens
tagcttatcagactg

SEQ ID NO: 681 - DNA, 21 bp, Homo sapiens
gagaactgaattccatgggtt

SEQ ID NO: 682 - DNA, 22 bp, Homo sapiens
taaagctagataaccgaaagta

SEQ ID NO: 683 - DNA, 21 bp, Homo sapiens
tgttgtacttttttttttgtt

SEQ ID NO: 684 - DNA, 19 bp, Homo sapiens
tgaggtaggaggttgtata

SEQ ID NO: 685 - DNA, 23 bp, Homo sapiens
actccatttgttttgatgatgga

SEQ ID NO: 686 - DNA, 19 bp, Homo sapiens
tagcagcacgtaaatattg

SEQ ID NO: 687 - DNA, 23 bp, Homo sapiens
atataatacaacctgctaagtgt

SEQ ID NO: 688 - DNA, 23 bp, Homo sapiens
ttacagttgttcaaccagttact

SEQ ID NO: 689 - DNA, 21 bp, Homo sapiens
gatatcatcatatactgtaag

SEQ ID NO: 690 - DNA, 21 bp, Homo sapiens
ttataaagcaatgagactgat

SEQ ID NO: 691 - DNA, 23 bp, Homo sapiens
aaccactgaccgttgactgtacc

SEQ ID NO: 692 - DNA, 19 bp, Homo sapiens
gtccagttttcccaggaat

SEQ ID NO: 693 - DNA, 17 bp, Homo sapiens
tagcttatcagactgat

SEQ ID NO: 694 - DNA, 20 bp, Homo sapiens
tcagtgcatgacagaacttg

SEQ ID NO: 695 - DNA, 22 bp, Homo sapiens
gtgaggtagtaggttgtatagt

SEQ ID NO: 696 - DNA, 20 bp, Homo sapiens
cttatcagactgatgttgac

SEQ ID NO: 697 - DNA, 21 bp, Homo sapiens
gcgacccatacttggtttcag

SEQ ID NO: 698 - DNA, 21 bp, Homo sapiens
tgaccgatttctcctggtgtt

SEQ ID NO: 699 - DNA, 21 bp, Homo sapiens
gctacattgtctgctgggttt

SEQ ID NO: 700 - DNA, 22 bp, Homo sapiens
taaggtgcatctagtgcagata

SEQ ID NO: 701 - DNA, 21 bp, Homo sapiens
agctacattgtctgctgggtt

SEQ ID NO: 702 - DNA, 22 bp, Homo sapiens
ttttgcgatgtgttcctaatat

SEQ ID NO: 703 - DNA, 22 bp, Homo sapiens
aacccgtagatccgatcttgtg

SEQ ID NO: 704 - DNA, 21 bp, Homo sapiens
tcagcaccaggatattgttgg

SEQ ID NO: 705 - DNA, 23 bp, Homo sapiens
ctcctgactccaggtcctgtgtg

SEQ ID NO: 706 - DNA, 21 bp, Homo sapiens
attggtacgtctgtgggtaga

SEQ ID NO: 707 - DNA, 22 bp, Homo sapiens
cagtgcaatagtattgtcaaag

SEQ ID NO: 708 - DNA, 20 bp, Homo sapiens
taccctgtagaaccgaattt

SEQ ID NO: 709 - DNA, 20 bp, Homo sapiens
acagtagtctgcacattggt

SEQ ID NO: 710 - DNA, 21 bp, Homo sapiens
taaagtgcttatagtgcaggt

SEQ ID NO: 711 - DNA, 23 bp, Homo sapiens
ttcaagtaatccaggataggctg

SEQ ID NO: 712 - DNA, 20 bp, Homo sapiens
accacagggtagaaccacgg

SEQ ID NO: 713 - DNA, 23 bp, Homo sapiens
gaaattattgtacatcggatgag

SEQ ID NO: 714 - DNA, 24 bp, Homo sapiens
aaaccgttaccattactgagttta

SEQ ID NO: 715 - DNA, 20 bp, Homo sapiens
tgattggtacgtctgtgggt

SEQ ID NO: 716 - DNA, 22 bp, Homo sapiens
attatggtttgcctgggactga

SEQ ID NO: 717 - DNA, 20 bp, Homo sapiens
tgaggtagtagtttgtgctg

SEQ ID NO: 718 - DNA, 22 bp, Homo sapiens
ttattgcttaagaatacgcgta

SEQ ID NO: 719 - DNA, 22 bp, Homo sapiens
tatacaagggcaagctctctgt

SEQ ID NO: 720 - DNA, 22 bp, Homo sapiens
tattgcttaagaatacgcgtag

SEQ ID NO: 721 - DNA, 20 bp, Homo sapiens
gcagtccatgggcatataca

SEQ ID NO: 722 - DNA, 24 bp, Homo sapiens
taccctgtagaaccgaatttgtgt

SEQ ID NO: 723 - DNA, 21 bp, Homo sapiens
aataatacatggttgatcttt

SEQ ID NO: 724 - DNA, 22 bp, Homo sapiens
tttttcattattgctcctgacc

SEQ ID NO: 725 - DNA, 21 bp, Homo sapiens
ttaatatcggacaaccattgt

SEQ ID NO: 726 - DNA, 21 bp, Homo sapiens
ttaatgctaatcgtgataggg

SEQ ID NO: 727 - DNA, 20 bp, Homo sapiens
caaagaattctccttttggg

SEQ ID NO: 728 - DNA, 23 bp, Homo sapiens
tgacacgatcactcccgttgagt

SEQ ID NO: 729 - DNA, 20 bp, Homo sapiens
tcccccaggtgtgattctga

SEQ ID NO: 730 - DNA, 19 bp, Homo sapiens
tcacattgccagggatttc

SEQ ID NO: 731 - DNA, 24 bp, Homo sapiens
aacattcaacgctgtcggtgagtt

SEQ ID NO: 732 - DNA, 18 bp, Homo sapiens
ctttcagtcggatgttta

SEQ ID NO: 733 - DNA, 22 bp, Homo sapiens
agctgccagttgaagaactgtt

SEQ ID NO: 734 - DNA, 21 bp, Homo sapiens
actccatttgttttgatgatg

SEQ ID NO: 735 - DNA, 21 bp, Homo sapiens
gcagcattgtacagggctatg

SEQ ID NO: 736 - DNA, 21 bp, Homo sapiens
aatataacacagatggcctgt

SEQ ID NO: 737 - DNA, 20 bp, Homo sapiens
tgttcgttcggctcgcgtga

SEQ ID NO: 738 - DNA, 21 bp, Homo sapiens
atcatcgtctcaaatgagtct

SEQ ID NO: 739 - DNA, 20 bp, Homo sapiens
tctgagatgaagcactgtag

SEQ ID NO: 740 - DNA, 20 bp, Homo sapiens
tcgaccggacctcgaccggc

SEQ ID NO: 741 - DNA, 23 bp, Homo sapiens
cagagcttagctgattggtgaac

SEQ ID NO: 742 - DNA, 22 bp, Homo sapiens
tttgttcgttcggctcgcgtga

SEQ ID NO: 743 - DNA, 21 bp, Homo sapiens
cagattcgattctaggggaat

SEQ ID NO: 744 - DNA, 23 bp, Homo sapiens
ctcgaggagctcacagtctagta

SEQ ID NO: 745 - DNA, 23 bp, Homo sapiens
tgaggtaggaggttgtatagttg

SEQ ID NO: 746 - DNA, 22 bp, Homo sapiens
gcagtccatgggcatatacact

SEQ ID NO: 747 - DNA, 21 bp, Homo sapiens
tcaggctcagtcccctcccga

SEQ ID NO: 748 - DNA, 21 bp, Homo sapiens
tgtgcaaatccatgcaaaact

SEQ ID NO: 749 - DNA, 22 bp, Homo sapiens
tttaggataagcttgacttttg

SEQ ID NO: 750 - DNA, 19 bp, Homo sapiens
tcacagtgaaccggtctct

SEQ ID NO: 751 - DNA, 21 bp, Homo sapiens
cacattacacggtcgacctct

SEQ ID NO: 752 - DNA, 20 bp, Homo sapiens
aacccgtagatccgaacttg

SEQ ID NO: 753 - DNA, 20 bp, Homo sapiens
tgaaatgtttaggaccacta

SEQ ID NO: 754 - DNA, 28 bp, Homo sapiens
tagcttatcagactgatgttgactgttg

SEQ ID NO: 755 - DNA, 22 bp, Homo sapiens
tgaccgatttctcctggtgttc

SEQ ID NO: 756 - DNA, 21 bp, Homo sapiens
cttatcagactgatgttgact

SEQ ID NO: 757 - DNA, 19 bp, Homo sapiens
cattattacttttggtacg

SEQ ID NO: 758 - DNA, 21 bp, Homo sapiens
ataaagctagataaccgaaag

SEQ ID NO: 759 - DNA, 20 bp, Homo sapiens
taccacagggtagaaccacg

SEQ ID NO: 760 - DNA, 22 bp, Homo sapiens
tcacagtgaaccggtctctttt

SEQ ID NO: 761 - DNA, 19 bp, Homo sapiens
ctcactgaacaatgaatgc

SEQ ID NO: 762 - DNA, 21 bp, Homo sapiens
tcctatatgatgcctttcttc

SEQ ID NO: 763 - DNA, 23 bp, Homo sapiens
gtcagtgcactacagaactttgt

SEQ ID NO: 764 - DNA, 21 bp, Homo sapiens
aaggagcttacaatctagctg

SEQ ID NO: 765 - DNA, 21 bp, Homo sapiens
tagcagcacgtaaatattggc

SEQ ID NO: 766 - DNA, 22 bp, Homo sapiens
ctgtacagcctcctagctttcc

SEQ ID NO: 767 - DNA, 23 bp, Homo sapiens
tgtatggcactggtagaattcac

SEQ ID NO: 768 - DNA, 20 bp, Homo sapiens
tggaatgtaaagaagtatgt

SEQ ID NO: 769 - DNA, 26 bp, Homo sapiens
tttggcaatggtagaactcacactgg

SEQ ID NO: 770 - DNA, 20 bp, Homo sapiens
ctgacctatgaattgacagc

SEQ ID NO: 771 - DNA, 20 bp, Homo sapiens
cagtgcaatgttaaaagggc

SEQ ID NO: 772 - DNA, 22 bp, Homo sapiens
cagtgcactacagaactttgtc

SEQ ID NO: 773 - DNA, 23 bp, Homo sapiens
atactgcatcaggaactgattgg

SEQ ID NO: 774 - DNA, 22 bp, Homo sapiens
tttcagtcggatgtttgcagct

SEQ ID NO: 775 - DNA, 19 bp, Homo sapiens
taaagtgctgacagtgcag

SEQ ID NO: 776 - DNA, 19 bp, Homo sapiens
tatcagactgatgttgact

SEQ ID NO: 777 - DNA, 29 bp, Homo sapiens
tagcttatcagactgatgttgactgttga

SEQ ID NO: 778 - DNA, 21 bp, Homo sapiens
tgggtctttgcgggcgagatg

SEQ ID NO: 779 - DNA, 21 bp, Homo sapiens
tagtgtttcctactttatgga

SEQ ID NO: 780 - DNA, 20 bp, Homo sapiens
catcttccagtacagtgttg

SEQ ID NO: 781 - DNA, 22 bp, Homo sapiens
caagctcgtgtctgtgggtccg

SEQ ID NO: 782 - DNA, 21 bp, Homo sapiens
aacaccagtcgatgggctgtc

SEQ ID NO: 783 - DNA, 21 bp, Homo sapiens
cagtagtctgcacattggtta

SEQ ID NO: 784 - DNA, 23 bp, Homo sapiens
gtgcctactgagctgaaacacag

SEQ ID NO: 785 - DNA, 22 bp, Homo sapiens
ctcctatatgatgcctttcttc

SEQ ID NO: 786 - DNA, 19 bp, Homo sapiens
aacattcaacgctgtcggt

SEQ ID NO: 787 - DNA, 18 bp, Homo sapiens
tccttcattccaccggag

SEQ ID NO: 788 - DNA, 23 bp, Homo sapiens
caagtcactagtggttccgttta

SEQ ID NO: 789 - DNA, 22 bp, Homo sapiens
tactagactgaagctccttgag

SEQ ID NO: 790 - DNA, 21 bp, Homo sapiens
accatcgaccgttgagtggac

SEQ ID NO: 791 - DNA, 20 bp, Homo sapiens
aaccactgaccgttgactgt

SEQ ID NO: 792 - DNA, 23 bp, Homo sapiens
ttatcagaatctccaggggtact

SEQ ID NO: 793 - DNA, 23 bp, Homo sapiens
tgaggtagtagtttgtacagttt

SEQ ID NO: 794 - DNA, 20 bp, Homo sapiens
acaagtcaggctcttgggac

SEQ ID NO: 795 - DNA, 22 bp, Homo sapiens
tcagtgcatgacagaacttggg

SEQ ID NO: 796 - DNA, 21 bp, Homo sapiens
aggcaagatgctggcatagct

SEQ ID NO: 797 - DNA, 19 bp, Homo sapiens
ttggttatctagctgtatg

SEQ ID NO: 798 - DNA, 22 bp, Homo sapiens
accatcgaccgttgagtggacc

SEQ ID NO: 799 - DNA, 20 bp, Homo sapiens
tgtaaacatccttgactgga

SEQ ID NO: 800 - DNA, 22 bp, Homo sapiens
atggttgaccagagagcacacg

SEQ ID NO: 801 - DNA, 19 bp, Homo sapiens
ttcacagtggctaagttcc

SEQ ID NO: 802 - DNA, 21 bp, Homo sapiens
tatgtctgctgaccatcacct

SEQ ID NO: 803 - DNA, 21 bp, Homo sapiens
aatcactaaccacacggccag

SEQ ID NO: 804 - DNA, 23 bp, Homo sapiens
taatactgccgggtaatgatgga

SEQ ID NO: 805 - DNA, 24 bp, Homo sapiens
atcacattgccagggattaccacg

SEQ ID NO: 806 - DNA, 21 bp, Homo sapiens
ctgtacaggccactgccttgc

SEQ ID NO: 807 - DNA, 20 bp, Homo sapiens
cccagtgtttagactatctg

SEQ ID NO: 808 - DNA, 18 bp, Homo sapiens
ttcacagtggctaagttc

SEQ ID NO: 809 - DNA, 21 bp, Homo sapiens
tgctgacatatttactagagg

SEQ ID NO: 810 - DNA, 21 bp, Homo sapiens
aacattcattgttgtcggtgg

SEQ ID NO: 811 - DNA, 22 bp, Homo sapiens
tctgacctatgaattgacagcc

SEQ ID NO: 812 - DNA, 21 bp, Homo sapiens
tagtagaccgtatagcgtacg

SEQ ID NO: 813 - DNA, 20 bp, Homo sapiens
taggtagtttcatgttgttg

SEQ ID NO: 814 - DNA, 22 bp, Homo sapiens
ggtgcagtgctgcatctctggt

SEQ ID NO: 815 - DNA, 22 bp, Homo sapiens
cggggttttgagggcgagatga

SEQ ID NO: 816 - DNA, 21 bp, Homo sapiens
taccacagggtagaaccacgg

SEQ ID NO: 817 - DNA, 18 bp, Homo sapiens
aagctgccagttgaagaa

SEQ ID NO: 818 - DNA, 21 bp, Homo sapiens
aatggcgccactagggttgtg

SEQ ID NO: 819 - DNA, 21 bp, Homo sapiens
aacatagaggaaattccacgt

SEQ ID NO: 820 - DNA, 22 bp, Homo sapiens
caacctggaggactccatgctg

SEQ ID NO: 821 - DNA, 20 bp, Homo sapiens
catgccttgagtgtaggacc

SEQ ID NO: 822 - DNA, 23 bp, Homo sapiens
tgaggtagtaggttgtatggttt

SEQ ID NO: 823 - DNA, 18 bp, Homo sapiens
aacccgtagatccgaact

SEQ ID NO: 824 - DNA, 21 bp, Homo sapiens
cccaatacacggtcgacctct

SEQ ID NO: 825 - DNA, 22 bp, Homo sapiens
gtcatacacggctctcctctct

SEQ ID NO: 826 - DNA, 22 bp, Homo sapiens
gtgaggactcgggaggtggagg

SEQ ID NO: 827 - DNA, 23 bp, Homo sapiens
tactagactgaagctccttgagg

SEQ ID NO: 828 - DNA, 22 bp, Homo sapiens
tccagttttcccaggaatccct

SEQ ID NO: 829 - DNA, 24 bp, Homo sapiens
ttgattgacacttctgtgagtaga

SEQ ID NO: 830 - DNA, 23 bp, Homo sapiens
accctgtagatccgaatttgtgt

SEQ ID NO: 831 - DNA, 21 bp, Homo sapiens
caaattcgtatctaggggaat

SEQ ID NO: 832 - DNA, 22 bp, Homo sapiens
actccatttgttttgatgatgg

SEQ ID NO: 833 - DNA, 20 bp, Homo sapiens
caaagtgctgttcgtgcagg

SEQ ID NO: 834 - DNA, 22 bp, Homo sapiens
ttgtacatggtaggctttcatt

SEQ ID NO: 835 - DNA, 23 bp, Homo sapiens
ctgggagaaggctgtttactctt

SEQ ID NO: 836 - DNA, 24 bp, Homo sapiens
ttaatgctaatcgtgataggggtt

SEQ ID NO: 837 - DNA, 21 bp, Homo sapiens
atgacacgatcactcccgttg

SEQ ID NO: 838 - DNA, 20 bp, Homo sapiens
tagcagcacagaaatattgg

SEQ ID NO: 839 - DNA, 24 bp, Homo sapiens
cccagtgttcagactacctgttca

SEQ ID NO: 840 - DNA, 21 bp, Homo sapiens
cctgttctccattacttggct

SEQ ID NO: 841 - DNA, 21 bp, Homo sapiens
ttatggtttgcctgggactga

SEQ ID NO: 842 - DNA, 23 bp, Homo sapiens
aaagctgccagttgaagaactgt

SEQ ID NO: 843 - DNA, 20 bp, Homo sapiens
tatacgacctgctgcctttc

SEQ ID NO: 844 - DNA, 21 bp, Homo sapiens
gcctgtctacacttgctgtgc

SEQ ID NO: 845 - DNA, 21 bp, Homo sapiens
tttgtgacctggtccactaac

SEQ ID NO: 846 - DNA, 20 bp, Homo sapiens
tcacagtgaaccggtctctt

SEQ ID NO: 847 - DNA, 22 bp, Homo sapiens
tatcagactgatgttgactgtt

SEQ ID NO: 848 - DNA, 21 bp, Homo sapiens
attgcacggtatccatctgta

SEQ ID NO: 849 - DNA, 21 bp, Homo sapiens
agcttatcagactgatgttga

SEQ ID NO: 850 - DNA, 23 bp, Homo sapiens
taccctgtagatccgaatttgtg

SEQ ID NO: 851 - DNA, 23 bp, Homo sapiens
aattgcacggtatccatctgtaa

SEQ ID NO: 852 - DNA, 25 bp, Homo sapiens
gtaaacatccttgactggaagctgt

SEQ ID NO: 853 - DNA, 19 bp, Homo sapiens
ttatcagactgatgttgac

SEQ ID NO: 854 - DNA, 19 bp, Homo sapiens
cacccgtagaaccgacctt

SEQ ID NO: 855 - DNA, 22 bp, Homo sapiens
tttgtgacctggtccactaacc

SEQ ID NO: 856 - DNA, 21 bp, Homo sapiens
gattcctggaaatactgttct

SEQ ID NO: 857 - DNA, 18 bp, Homo sapiens
tggctcagttcagcagga

SEQ ID NO: 858 - DNA, 17 bp, Homo sapiens
ctttcagtcggatgttt

SEQ ID NO: 859 - DNA, 22 bp, Homo sapiens
tggaagactagtgattttgttg

SEQ ID NO: 860 - DNA, 21 bp, Homo sapiens
accgttaccattactgagttt

SEQ ID NO: 861 - DNA, 22 bp, Homo sapiens
tggtagactatggaacgtaggc

SEQ ID NO: 862 - DNA, 20 bp, Homo sapiens
ctagattgtgagctcctgga

SEQ ID NO: 863 - DNA, 21 bp, Homo sapiens
aaccgttaccattactgagtt

SEQ ID NO: 864 - DNA, 17 bp, Homo sapiens
gcacgtaaatattggcg

SEQ ID NO: 865 - DNA, 24 bp, Homo sapiens
ttggtccccttcaaccagctgtag

SEQ ID NO: 866 - DNA, 22 bp, Homo sapiens
cagcagcaattcatgttttgaa

SEQ ID NO: 867 - DNA, 20 bp, Homo sapiens
cagtagtctgcacattggtt

SEQ ID NO: 868 - DNA, 23 bp, Homo sapiens
tgtagtgtttcctactttatgga

SEQ ID NO: 869 - DNA, 19 bp, Homo sapiens
ctggactgagccgtgctac

SEQ ID NO: 870 - DNA, 23 bp, Homo sapiens
tcttggagtaggtcattgggtgg

SEQ ID NO: 871 - DNA, 21 bp, Homo sapiens
aacgccattatcacactaaat

SEQ ID NO: 872 - DNA, 24 bp, Homo sapiens
gtgcctactgagctgaaacacagt

SEQ ID NO: 873 - DNA, 21 bp, Homo sapiens
tggaatgtaaagaagtatgta

SEQ ID NO: 874 - DNA, 21 bp, Homo sapiens
tgaggtagtaagttgtattgt

SEQ ID NO: 875 - DNA, 22 bp, Homo sapiens
gaatgttgctcggtgaacccct

SEQ ID NO: 876 - DNA, 23 bp, Homo sapiens
gtgcctactgagctgatatcagt

SEQ ID NO: 877 - DNA, 22 bp, Homo sapiens
tgaggtagtaagttgtattgtt

SEQ ID NO: 878 - DNA, 22 bp, Homo sapiens
cagcattgtacagggctatgaa

SEQ ID NO: 879 - DNA, 19 bp, Homo sapiens
ctttcagtcggatgtttgc

SEQ ID NO: 880 - DNA, 22 bp, Homo sapiens
tcgaccggacctcgaccggctc

SEQ ID NO: 881 - DNA, 21 bp, Homo sapiens
tacgtcatcgttgtcatcgtc

SEQ ID NO: 882 - DNA, 24 bp, Homo sapiens
atctttggttatctagctgtatga

SEQ ID NO: 883 - DNA, 23 bp, Homo sapiens
tcccccaggtgtgattctgattt

SEQ ID NO: 884 - DNA, 21 bp, Homo sapiens
gactatagaactttccccctc

SEQ ID NO: 885 - DNA, 21 bp, Homo sapiens
ctgtatgccctcaccgctcag

SEQ ID NO: 886 - DNA, 22 bp, Homo sapiens
gctcggtctgaggcccctcagt

SEQ ID NO: 887 - DNA, 19 bp, Homo sapiens
tttcagtcggatgtttaca

SEQ ID NO: 888 - DNA, 23 bp, Homo sapiens
agctggtgttgtgaatcaggccg

SEQ ID NO: 889 - DNA, 19 bp, Homo sapiens
tgaggtagtaggttgtatg

SEQ ID NO: 890 - DNA, 19 bp, Homo sapiens
tggttatctagctgtatga

SEQ ID NO: 891 - DNA, 22 bp, Homo sapiens
tacccattgcatatcggagttg

SEQ ID NO: 892 - DNA, 20 bp, Homo sapiens
tttccggctcgcgtgggtgt

SEQ ID NO: 893 - DNA, 24 bp, Homo sapiens
aacattcattgctgtcggtgggtt

SEQ ID NO: 894 - DNA, 20 bp, Homo sapiens
ttaatatcggacaaccattg

SEQ ID NO: 895 - DNA, 24 bp, Homo sapiens
aatgacacgatcactcccgttgag

SEQ ID NO: 896 - DNA, 20 bp, Homo sapiens
cagcattgtacagggctatg

SEQ ID NO: 897 - DNA, 20 bp, Homo sapiens
ttatggtttgcctgggactg

SEQ ID NO: 898 - DNA, 23 bp, Homo sapiens
tcacattgccagggattaccacg

SEQ ID NO: 899 - DNA, 22 bp, Homo sapiens
tggtttaccgtcccacatacat

SEQ ID NO: 900 - DNA, 19 bp, Homo sapiens
aacccgtagatccgatctt

SEQ ID NO: 901 - DNA, 20 bp, Homo sapiens
tagcaccatttgaaatcagt

SEQ ID NO: 902 - DNA, 20 bp, Homo sapiens
taaagtgctgacagtgcaga

SEQ ID NO: 903 - DNA, 18 bp, Homo sapiens
gatgaagcactgtagctc

SEQ ID NO: 904 - DNA, 20 bp, Homo sapiens
ctttcagtcggatgtttgca

SEQ ID NO: 905 - DNA, 23 bp, Homo sapiens
ttggcaatggtagaactcacact

SEQ ID NO: 906 - DNA, 20 bp, Homo sapiens
acccgtagatccgatcttgt

SEQ ID NO: 907 - DNA, 22 bp, Homo sapiens
tagcagcgggaacagttctgca

SEQ ID NO: 908 - DNA, 22 bp, Homo sapiens
aatcactaaccacacggccagg

SEQ ID NO: 909 - DNA, 20 bp, Homo sapiens
aaaccgttaccattactgag

SEQ ID NO: 910 - DNA, 22 bp, Homo sapiens
ttgcagctgcctgggagtgact

SEQ ID NO: 911 - DNA, 17 bp, Homo sapiens
tagcaccatctgaaatc

SEQ ID NO: 912 - DNA, 23 bp, Homo sapiens
atctttggttatctagctgtatg

SEQ ID NO: 913 - DNA, 22 bp, Homo sapiens
ccagtgttcagactacctgttc

SEQ ID NO: 914 - DNA, 22 bp, Homo sapiens
gaaaagctgggttgagagggcg

SEQ ID NO: 915 - DNA, 23 bp, Homo sapiens
tgtaacagcaactccatgtggac

SEQ ID NO: 916 - DNA, 17 bp, Homo sapiens
taccctgtagaaccgaa

SEQ ID NO: 917 - DNA, 21 bp, Homo sapiens
tcctgtactgagctgccccga

SEQ ID NO: 918 - DNA, 20 bp, Homo sapiens
tgtaacagcaactccatgtg

SEQ ID NO: 919 - DNA, 19 bp, Homo sapiens
tcggatccgtctgagcttg

SEQ ID NO: 920 - DNA, 21 bp, Homo sapiens
caagtcactagtggttccgtt

SEQ ID NO: 921 - DNA, 23 bp, Homo sapiens
ctcgtaccgtgagtaataatgcg

SEQ ID NO: 922 - DNA, 22 bp, Homo sapiens
tctgagatgaagcactgtagct

SEQ ID NO: 923 - DNA, 24 bp, Homo sapiens
caaagtgctcatagtgcaggtagt

SEQ ID NO: 924 - DNA, 20 bp, Homo sapiens
taaacatcctcgactggaag

SEQ ID NO: 925 - DNA, 19 bp, Homo sapiens
gactatagaactttccccc

SEQ ID NO: 926 - DNA, 22 bp, Homo sapiens
atgcagtccatgggcatataca

SEQ ID NO: 927 - DNA, 17 bp, Homo sapiens
ctgacctatgaattgac

SEQ ID NO: 928 - DNA, 22 bp, Homo sapiens
atcacaagtcaggctcttggga

SEQ ID NO: 929 - DNA, 22 bp, Homo sapiens
accctgtagatccgaatttgtg

SEQ ID NO: 930 - DNA, 22 bp, Homo sapiens
ctggccctctctgcccttccgt

SEQ ID NO: 931 - DNA, 22 bp, Homo sapiens
aagtgcttccatgttttagtag

SEQ ID NO: 932 - DNA, 19 bp, Homo sapiens
tgaggtagtagtttgtaca

SEQ ID NO: 933 - DNA, 23 bp, Homo sapiens
tattcatttatccccagcctaca

SEQ ID NO: 934 - DNA, 22 bp, Homo sapiens
gcacattacacggtcgacctct

SEQ ID NO: 935 - DNA, 22 bp, Homo sapiens
gtgcctactgagctgaaacaca

SEQ ID NO: 936 - DNA, 22 bp, Homo sapiens
taagtgcttccatgttttggtg

SEQ ID NO: 937 - DNA, 23 bp, Homo sapiens
taagtgcttccatgttttggtga

SEQ ID NO: 938 - DNA, 23 bp, Homo sapiens
taagtgcttccatgtttgagtgt

SEQ ID NO: 939 - DNA, 21 bp, Homo sapiens
acccgtcccgttcgtccccgg

SEQ ID NO: 940 - DNA, 25 bp, Homo sapiens
tctcacacagaaatcgcacccgtca

SEQ ID NO: 941 - DNA, 21 bp, Homo sapiens
ttgaaacaatctctactgaac

SEQ ID NO: 942 - DNA, 18 bp, Homo sapiens
aacattcaacgctgtcgg

SEQ ID NO: 943 - DNA, 23 bp, Homo sapiens
cgtgtatttgacaagctgagttg

SEQ ID NO: 944 - DNA, 23 bp, Homo sapiens
taaacgtggatgtacttgctttg

SEQ ID NO: 945 - DNA, 18 bp, Homo sapiens
atggcactggtagaattc

SEQ ID NO: 946 - DNA, 22 bp, Homo sapiens
tagcagcacataatggtttgtg

SEQ ID NO: 947 - DNA, 17 bp, Homo sapiens
cacccgtagaaccgacc

SEQ ID NO: 948 - DNA, 23 bp, Homo sapiens
tagcagcacgtaaatattggcgt

SEQ ID NO: 949 - DNA, 18 bp, Homo sapiens
gtagtctgcacattggtt

SEQ ID NO: 950 - DNA, 15 bp, Homo sapiens
taccctgtagaaccg

SEQ ID NO: 951 - DNA, 18 bp, Homo sapiens
taacactgtctggtaaag

SEQ ID NO: 952 - DNA, 22 bp, Homo sapiens
ttcaacgggtatttattgagca

SEQ ID NO: 953 - DNA, 22 bp, Homo sapiens
aagtgcttccatgtttgagtgt

SEQ ID NO: 954 - DNA, 24 bp, Homo sapiens
tctttggttatctagctgtatgag

SEQ ID NO: 955 - DNA, 19 bp, Homo sapiens
atgacctatgaattgacag

SEQ ID NO: 956 - DNA, 20 bp, Homo sapiens
cgggaacgtcgagactggag

SEQ ID NO: 957 - DNA, 21 bp, Homo sapiens
taagtgcttccatgttttggt

SEQ ID NO: 958 - DNA, 22 bp, Homo sapiens
gtgtcagtttgtcaaatacccc

SEQ ID NO: 959 - DNA, 18 bp, Homo sapiens
atgaagcactgtagctca

SEQ ID NO: 960 - DNA, 19 bp, Homo sapiens
aaccgttaccattactgag

SEQ ID NO: 961 - DNA, 22 bp, Homo sapiens
ctgcagtgaaggcacttgtagc

SEQ ID NO: 962 - DNA, 22 bp, Homo sapiens
gagaattgtggctggacatctg

SEQ ID NO: 963 - DNA, 21 bp, Homo sapiens
acccgtagatccgaacttgtg

SEQ ID NO: 964 - DNA, 20 bp, Homo sapiens
tttcagtcggatgtttacag

SEQ ID NO: 965 - DNA, 20 bp, Homo sapiens
atccccagatacaatggaca

SEQ ID NO: 966 - DNA, 21 bp, Homo sapiens
tcgtgtcttgtgttgcagccg

SEQ ID NO: 967 - DNA, 22 bp, Homo sapiens
aagctgggttgagagggcgaaa

SEQ ID NO: 968 - DNA, 21 bp, Homo sapiens
tttggtccccttcaaccagct

SEQ ID NO: 969 - DNA, 21 bp, Homo sapiens
acccgtagaaccgaccttgcg

SEQ ID NO: 970 - DNA, 21 bp, Homo sapiens
tgacacgatcactcccgttga

SEQ ID NO: 971 - DNA, 23 bp, Homo sapiens
catgccttgagtgtaggaccgtt

SEQ ID NO: 972 - DNA, 21 bp, Homo sapiens
ctatacggcctcctagctttc

SEQ ID NO: 973 - DNA, 23 bp, Homo sapiens
tgtcagtttgtcaaataccccaa

SEQ ID NO: 974 - DNA, 21 bp, Homo sapiens
ctgggaggtggatgtttactt

SEQ ID NO: 975 - DNA, 21 bp, Homo sapiens
aacggaatcccaaaagcagct

SEQ ID NO: 976 - DNA, 21 bp, Homo sapiens
aggttacccgagcaactttgc

SEQ ID NO: 977 - DNA, 22 bp, Homo sapiens
aagcccttaccccaaaaagcat

SEQ ID NO: 978 - DNA, 20 bp, Homo sapiens
tgtgacagattgataactga

SEQ ID NO: 979 - DNA, 22 bp, Homo sapiens
gagtctccagtaatggacggga

SEQ ID NO: 980 - DNA, 20 bp, Homo sapiens
tgagaactgaattccatagg

SEQ ID NO: 981 - DNA, 19 bp, Homo sapiens
catgttgccagtctctagg

SEQ ID NO: 982 - DNA, 21 bp, Homo sapiens
gtgccgccatcttttgagtgt

SEQ ID NO: 983 - DNA, 22 bp, Homo sapiens
cctcctgccctccttgctgtag

SEQ ID NO: 984 - DNA, 21 bp, Homo sapiens
ccagtggggctgctgttatct

SEQ ID NO: 985 - DNA, 19 bp, Homo sapiens
ccctgtagatccgaatttg

SEQ ID NO: 986 - DNA, 21 bp, Homo sapiens
aagtgccgccatcttttgagt

SEQ ID NO: 987 - DNA, 22 bp, Homo sapiens
actcaaactgtgggggcacttt

SEQ ID NO: 988 - DNA, 19 bp, Homo sapiens
tggagtgtgacaatggtgt

SEQ ID NO: 989 - DNA, 21 bp, Homo sapiens
atataatacaacctgctaagt

SEQ ID NO: 990 - DNA, 21 bp, Homo sapiens
ttggcaatggtagaactcaca

SEQ ID NO: 991 - DNA, 23 bp, Homo sapiens
accctgtagaaccgaatttgtgt

SEQ ID NO: 992 - DNA, 23 bp, Homo sapiens
aatgcacccgggcaaggattctg

SEQ ID NO: 993 - DNA, 19 bp, Homo sapiens
cttatcagattgtattgta

SEQ ID NO: 994 - DNA, 20 bp, Homo sapiens
acattcattgctgtcggtgg

SEQ ID NO: 995 - DNA, 24 bp, Homo sapiens
ttgtgaaatgtttaggaccactag

SEQ ID NO: 996 - DNA, 21 bp, Homo sapiens
cattcaacgctgtcggtgagt

SEQ ID NO: 997 - DNA, 17 bp, Homo sapiens
aagctgccagttgaaga

SEQ ID NO: 998 - DNA, 21 bp, Homo sapiens
aacaggtgactggttagacaa

SEQ ID NO: 999 - DNA, 22 bp, Homo sapiens
tattgcactcgtcccggcctcc

SEQ ID NO: 1000 - DNA, 21 bp, Homo sapiens
aagtgctgcgacatttgagcg

SEQ ID NO: 1001 - DNA, 22 bp, Homo sapiens
gttcctgctgaactgagccagt

SEQ ID NO: 1002 - DNA, 21 bp, Homo sapiens
gcagtccatgggcatatacac

SEQ ID NO: 1003 - DNA, 20 bp, Homo sapiens
gtaaacatccttgactggaa

SEQ ID NO: 1004 - DNA, 19 bp, Homo sapiens
tttggttatctagctgtat

SEQ ID NO: 1005 - DNA, 20 bp, Homo sapiens
agcattgtacagggctatga

SEQ ID NO: 1006 - DNA, 22 bp, Homo sapiens
aatactgccgggtaatgatgga

SEQ ID NO: 1007 - DNA, 24 bp, Homo sapiens
atcacattgccagggatttccaac

SEQ ID NO: 1008 - DNA, 20 bp, Homo sapiens
atgacctatgaattgacaga

SEQ ID NO: 1009 - DNA, 24 bp, Homo sapiens
tgatactgtaaacgctttctgatg

SEQ ID NO: 1010 - DNA, 22 bp, Homo sapiens
aaatgctcagactcctgtggtg

SEQ ID NO: 1011 - DNA, 20 bp, Homo sapiens
tactgccgggtaatgatgga

SEQ ID NO: 1012 - DNA, 22 bp, Homo sapiens
taagtgcttccatgtttgagtg

SEQ ID NO: 1013 - DNA, 22 bp, Homo sapiens
ctgagacctctgggttctgagc

SEQ ID NO: 1014 - DNA, 24 bp, Homo sapiens
tctcacacagaaatcgcacccgtc

SEQ ID NO: 1015 - DNA, 23 bp, Homo sapiens
taaagctagataaccgaaagtaa

SEQ ID NO: 1016 - DNA, 17 bp, Homo sapiens
atgaagcactgtagctc

SEQ ID NO: 1017 - DNA, 25 bp, Homo sapiens
tttggcaatggtagaactcacactg

SEQ ID NO: 1018 - DNA, 24 bp, Homo sapiens
ataaagctagataaccgaaagtag

SEQ ID NO: 1019 - DNA, 18 bp, Homo sapiens
gtaaacatccttgactgg

SEQ ID NO: 1020 - DNA, 19 bp, Homo sapiens
cctgtagatccgaatttgt

SEQ ID NO: 1021 - DNA, 21 bp, Homo sapiens
tagcaccatttgaaatcagtg

SEQ ID NO: 1022 - DNA, 22 bp, Homo sapiens
tgtctactactggagacactgg

SEQ ID NO: 1023 - DNA, 20 bp, Homo sapiens
cggaatcccaaaagcagctg

SEQ ID NO: 1024 - DNA, 22 bp, Homo sapiens
ggctcagtagccagtgtagatc

SEQ ID NO: 1025 - DNA, 22 bp, Homo sapiens
aaaccgttaccattactgagtt

SEQ ID NO: 1026 - DNA, 24 bp, Homo sapiens
caacggaatcccaaaagcagctgt

SEQ ID NO: 1027 - DNA, 23 bp, Homo sapiens
taatgcccctaaaaatccttatt

SEQ ID NO: 1028 - DNA, 22 bp, Homo sapiens
tcctgactccaggtcctgtgtg

SEQ ID NO: 1029 - DNA, 21 bp, Homo sapiens
taagtgcttccatgtttcagt

SEQ ID NO: 1030 - DNA, 22 bp, Homo sapiens
cctcccacacccaaggcttgca

SEQ ID NO: 1031 - DNA, 20 bp, Homo sapiens
aaggagctcacagtctattg

SEQ ID NO: 1032 - DNA, 20 bp, Homo sapiens
cctctgggcccttcctccag

SEQ ID NO: 1033 - DNA, 24 bp, Homo sapiens
tgtgaaatgtttaggaccactaga

SEQ ID NO: 1034 - DNA, 19 bp, Homo sapiens
gcttatcagactgatgttg

SEQ ID NO: 1035 - DNA, 21 bp, Homo sapiens
aaatgctcagactcctgtggt

SEQ ID NO: 1036 - DNA, 17 bp, Homo sapiens
tgaggtagtaggttgtg

SEQ ID NO: 1037 - DNA, 19 bp, Homo sapiens
ctgtagatccgaatttgtg

SEQ ID NO: 1038 - DNA, 15 bp, Homo sapiens
accctgtagaaccga

SEQ ID NO: 1039 - DNA, 21 bp, Homo sapiens
tactagactgaagctccttga

SEQ ID NO: 1040 - DNA, 23 bp, Homo sapiens
tacccattgcatatcggagttgt

SEQ ID NO: 1041 - DNA, 21 bp, Homo sapiens
cagcagcaattcatgttttga

SEQ ID NO: 1042 - DNA, 20 bp, Homo sapiens
caaagtgcttacagtgcagg

SEQ ID NO: 1043 - DNA, 22 bp, Homo sapiens
tacagtagtctgcacattggtt

SEQ ID NO: 1044 - DNA, 23 bp, Homo sapiens
aaaccgttaccattactgagttt

SEQ ID NO: 1045 - DNA, 22 bp, Homo sapiens
atactgcatcaggaactgattg

SEQ ID NO: 1046 - DNA, 22 bp, Homo sapiens
ccacctcccctgcaaacgtcca

SEQ ID NO: 1047 - DNA, 21 bp, Homo sapiens
ttgcagctgcctgggagtgac

SEQ ID NO: 1048 - DNA, 18 bp, Homo sapiens
tagcttatcagactgatg

SEQ ID NO: 1049 - DNA, 23 bp, Homo sapiens
cgaatgttgctcggtgaacccct

SEQ ID NO: 1050 - DNA, 20 bp, Homo sapiens
tgtttgcagaggaaactgag

SEQ ID NO: 1051 - DNA, 21 bp, Homo sapiens
taccctgtagatccgaatttg

SEQ ID NO: 1052 - DNA, 24 bp, Homo sapiens
aatgcacctgggcaaggattctga

SEQ ID NO: 1053 - DNA, 22 bp, Homo sapiens
aacaggtgactggttagacaaa

SEQ ID NO: 1054 - DNA, 19 bp, Homo sapiens
taatactgccgggtaatga

SEQ ID NO: 1055 - DNA, 23 bp, Homo sapiens
tggtcgaccagttggaaagtaat

SEQ ID NO: 1056 - DNA, 24 bp, Homo sapiens
cgtgtatttgacaagctgagttgg

SEQ ID NO: 1057 - DNA, 23 bp, Homo sapiens
tccctgtcctccaggagctcacg

SEQ ID NO: 1058 - DNA, 21 bp, Homo sapiens
ttgtgacagattgataactga

SEQ ID NO: 1059 - DNA, 23 bp, Homo sapiens
tttggttatctagctgtatgagt

SEQ ID NO: 1060 - DNA, 18 bp, Homo sapiens
taatactgcctggtaatg

SEQ ID NO: 1061 - DNA, 18 bp, Homo sapiens
ctgtagaaccgaatttgt

SEQ ID NO: 1062 - DNA, 18 bp, Homo sapiens
gcacgtaaatattggcgt

SEQ ID NO: 1063 - DNA, 21 bp, Homo sapiens
atgccttgagtgtaggaccgt

SEQ ID NO: 1064 - DNA, 19 bp, Homo sapiens
accgttaccattactgagt

SEQ ID NO: 1065 - DNA, 20 bp, Homo sapiens
ttttgcgatgtgttcctaat

SEQ ID NO: 1066 - DNA, 22 bp, Homo sapiens
atggctgtaccaccttgtcggg

SEQ ID NO: 1067 - DNA, 20 bp, Homo sapiens
taacactgtctggtaacgat

SEQ ID NO: 1068 - DNA, 18 bp, Homo sapiens
tatcagactgatgttgac

SEQ ID NO: 1069 - DNA, 22 bp, Homo sapiens
tgtagtgtttcctactttatgg

SEQ ID NO: 1070 - DNA, 22 bp, Homo sapiens
tcagtctcatctgcaaagaagt

SEQ ID NO: 1071 - DNA, 23 bp, Homo sapiens
tacagtactgtgataactgaaga

SEQ ID NO: 1072 - DNA, 20 bp, Homo sapiens
ggctcagtagccagtgtaga

SEQ ID NO: 1073 - DNA, 17 bp, Homo sapiens
ttcacagtggctaagtt

SEQ ID NO: 1074 - DNA, 22 bp, Homo sapiens
tgaggggcagagagcgagactt

SEQ ID NO: 1075 - DNA, 23 bp, Homo sapiens
ctaatactgtctggtaaaaccgt

SEQ ID NO: 1076 - DNA, 24 bp, Homo sapiens
accctgtagatccgaatttgtgta

SEQ ID NO: 1077 - DNA, 21 bp, Homo sapiens
tctgagatgaagcactgtagc

SEQ ID NO: 1078 - DNA, 24 bp, Homo sapiens
gtaaacatccttgactggaagctg

SEQ ID NO: 1079 - DNA, 19 bp, Homo sapiens
tacccagtctccggtgcag

SEQ ID NO: 1080 - DNA, 20 bp, Homo sapiens
accatcgaccgttgagtgga

SEQ ID NO: 1081 - DNA, 22 bp, Homo sapiens
ctcactgaacaatgaatgcaac

SEQ ID NO: 1082 - DNA, 24 bp, Homo sapiens
atactgcatcaggaactgattgga

SEQ ID NO: 1083 - DNA, 20 bp, Homo sapiens
ctatacaacctactgccttc

SEQ ID NO: 1084 - DNA, 25 bp, Homo sapiens
tagcttatcagactgatgttgactg

SEQ ID NO: 1085 - DNA, 25 bp, Homo sapiens
tgtaaacatcctcgactggaagctg

SEQ ID NO: 1086 - DNA, 20 bp, Homo sapiens
accgttaccattactgagtt

SEQ ID NO: 1087 - DNA, 22 bp, Homo sapiens
gattcctggaaatactgttctt

SEQ ID NO: 1088 - DNA, 20 bp, Homo sapiens
tatggcactggtagaattca

SEQ ID NO: 1089 - DNA, 22 bp, Homo sapiens
ctcctgactccaggtcctgtgt

SEQ ID NO: 1090 - DNA, 22 bp, Homo sapiens
tgtgacagattgataactgaaa

SEQ ID NO: 1091 - DNA, 21 bp, Homo sapiens
atactgccgggtaatgatgga

SEQ ID NO: 1092 - DNA, 22 bp, Homo sapiens
taactggttgaacaactgaacc

SEQ ID NO: 1093 - DNA, 18 bp, Homo sapiens
caacggaatcccaaaagc

SEQ ID NO: 1094 - DNA, 21 bp, Homo sapiens
ttggtccccttcaaccagctg

SEQ ID NO: 1095 - DNA, 22 bp, Homo sapiens
aggggtgctatctgtgattgag

SEQ ID NO: 1096 - DNA, 22 bp, Homo sapiens
tttcctatgcatatacttcttt

SEQ ID NO: 1097 - DNA, 23 bp, Homo sapiens
gaatgttgctcggtgaacccctt

SEQ ID NO: 1098 - DNA, 18 bp, Homo sapiens
tgggtctttgcgggcgag

SEQ ID NO: 1099 - DNA, 20 bp, Homo sapiens
tagcagcacgtaaatattgg

SEQ ID NO: 1100 - DNA, 21 bp, Homo sapiens
ttcaacgggtatttattgagc

SEQ ID NO: 1101 - DNA, 20 bp, Homo sapiens
attgacacttctgtgagtag

SEQ ID NO: 1102 - DNA, 21 bp, Homo sapiens
ccatcgaccgttgattgtacc

SEQ ID NO: 1103 - DNA, 20 bp, Homo sapiens
gcagcacgtaaatattggcg

SEQ ID NO: 1104 - DNA, 22 bp, Homo sapiens
tgcacctgggcaaggattctga

SEQ ID NO: 1105 - DNA, 21 bp, Homo sapiens
tttcagtcggatgtttgcagc

SEQ ID NO: 1106 - DNA, 17 bp, Homo sapiens
tccttcattccaccgga

SEQ ID NO: 1107 - DNA, 21 bp, Homo sapiens
gacctatgaattgacagccag

SEQ ID NO: 1108 - DNA, 24 bp, Homo sapiens
taggtagtttcctgttgttgggat

SEQ ID NO: 1109 - DNA, 19 bp, Homo sapiens
ggtagtaggttgtgtggtt

SEQ ID NO: 1110 - DNA, 19 bp, Homo sapiens
gtacagtactgtgataact

SEQ ID NO: 1111 - DNA, 17 bp, Homo sapiens
gtagtgtttcctacttt

SEQ ID NO: 1112 - DNA, 22 bp, Homo sapiens
tggcagtgtattgttagctggt

SEQ ID NO: 1113 - DNA, 16 bp, Homo sapiens
atgaagcactgtagct

SEQ ID NO: 1114 - DNA, 20 bp, Homo sapiens
atgacacgatcactcccgtt

SEQ ID NO: 1115 - DNA, 20 bp, Homo sapiens
acaccagtcgatgggctgtc

SEQ ID NO: 1116 - DNA, 22 bp, Homo sapiens
ctaatactgtctggtaaaaccg

SEQ ID NO: 1117 - DNA, 22 bp, Homo sapiens
gactccatttgttttgatgatg

SEQ ID NO: 1118 - DNA, 21 bp, Homo sapiens
tagcagcacataatggtttgt

SEQ ID NO: 1119 - DNA, 21 bp, Homo sapiens
aactggcctacaaagtcccag

SEQ ID NO: 1120 - DNA, 23 bp, Homo sapiens
tgcaacgaacctgagccactgat

SEQ ID NO: 1121 - DNA, 24 bp, Homo sapiens
ttggcaatggtagaactcacactg

SEQ ID NO: 1122 - DNA, 22 bp, Homo sapiens
atcggatccgtctgagcttggc

SEQ ID NO: 1123 - DNA, 21 bp, Homo sapiens
gaggtagtagattgtatagtt

SEQ ID NO: 1124 - DNA, 23 bp, Homo sapiens
aactggccctcaaagtcccgctt

SEQ ID NO: 1125 - DNA, 19 bp, Homo sapiens
ttttgttcgttcggctcgc

SEQ ID NO: 1126 - DNA, 21 bp, Homo sapiens
gaggtagtaggttgtgtggtt

SEQ ID NO: 1127 - DNA, 20 bp, Homo sapiens
ttcaagtaattcaggatagg

SEQ ID NO: 1128 - DNA, 20 bp, Homo sapiens
aacaggtgactggttagaca

SEQ ID NO: 1129 - DNA, 18 bp, Homo sapiens
agatgaagcactgtagct

SEQ ID NO: 1130 - DNA, 23 bp, Homo sapiens
acattcattgctgtcggtgggtt

SEQ ID NO: 1131 - DNA, 21 bp, Homo sapiens
cttatcagattgtattgtaat

SEQ ID NO: 1132 - DNA, 22 bp, Homo sapiens
aatactgcctggtaatgatgac

SEQ ID NO: 1133 - DNA, 20 bp, Homo sapiens
ttatcagactgatgttgact

SEQ ID NO: 1134 - DNA, 21 bp, Homo sapiens
accatcgaccgttgattgtac

SEQ ID NO: 1135 - DNA, 19 bp, Homo sapiens
ctgtgcgtgtgacagcggc

SEQ ID NO: 1136 - DNA, 22 bp, Homo sapiens
tgacacgatcactcccgttgag

SEQ ID NO: 1137 - DNA, 21 bp, Homo sapiens
tttggcactagcacatttttg

SEQ ID NO: 1138 - DNA, 23 bp, Homo sapiens
tggaatgtaaagaagtatgtatt

SEQ ID NO: 1139 - DNA, 21 bp, Homo sapiens
cattattacttttggtacgcg

SEQ ID NO: 1140 - DNA, 20 bp, Homo sapiens
actgccccaggtgctgctgg

SEQ ID NO: 1141 - DNA, 21 bp, Homo sapiens
catcgggaatgtcgtgtccgc

SEQ ID NO: 1142 - DNA, 23 bp, Homo sapiens
tctgagatgaagcactgtagctc

SEQ ID NO: 1143 - DNA, 20 bp, Homo sapiens
caatggtagaactcacactg

SEQ ID NO: 1144 - DNA, 18 bp, Homo sapiens
aacattcattgctgtcgg

SEQ ID NO: 1145 - DNA, 23 bp, Homo sapiens
tatcagactgatgttgactgttg

SEQ ID NO: 1146 - DNA, 21 bp, Homo sapiens
atccccagatacaatggacaa

SEQ ID NO: 1147 - DNA, 23 bp, Homo sapiens
atgacctatgaattgacagacaa

SEQ ID NO: 1148 - DNA, 21 bp, Homo sapiens
ttccctttgtcatccttcgcc

SEQ ID NO: 1149 - DNA, 23 bp, Homo sapiens
cgtcaacacttgctggtttcctc

SEQ ID NO: 1150 - DNA, 21 bp, Homo sapiens
tctacagtgcacgtgtctcca

SEQ ID NO: 1151 - DNA, 23 bp, Homo sapiens
tccgtctcagttactttatagcc

SEQ ID NO: 1152 - DNA, 22 bp, Homo sapiens
cataaagtagaaagcactacta

SEQ ID NO: 1153 - DNA, 21 bp, Homo sapiens
ttcctatgcatatacttcttt

SEQ ID NO: 1154 - DNA, 23 bp, Homo sapiens
acagggtagaaccacggacagga

SEQ ID NO: 1155 - DNA, 23 bp, Homo sapiens
aaagtgctgcgacatttgagcgt

SEQ ID NO: 1156 - DNA, 23 bp, Homo sapiens
tggagacgcggccctgttggagt

SEQ ID NO: 1157 - DNA, 22 bp, Homo sapiens
tggagacgcggccctgttggag

SEQ ID NO: 1158 - DNA, 22 bp, Homo sapiens
ttgcatagtcacaaaagtgatc

SEQ ID NO: 1159 - DNA, 23 bp, Homo sapiens
tactccagagggcgtcactcatg

SEQ ID NO: 1160 - DNA, 23 bp, Homo sapiens
tcaagagcaataacgaaaaatgt

SEQ ID NO: 1161 - DNA, 23 bp, Homo sapiens
ttattgcttaagaatacgcgtag

SEQ ID NO: 1162 - DNA, 24 bp, Homo sapiens
gtgaggactcgggaggtggagggt

SEQ ID NO: 1163 - DNA, 22 bp, Homo sapiens
ctgggaggtggatgtttacttc

SEQ ID NO: 1164 - DNA, 21 bp, Homo sapiens
gtgaggactcgggaggtggag

SEQ ID NO: 1165 - DNA, 18 bp, Homo sapiens
ctgtaccaccttgtcggg

SEQ ID NO: 1166 - DNA, 20 bp, Homo sapiens
gtgaggactcgggaggtgga

SEQ ID NO: 1167 - DNA, 24 bp, Homo sapiens
tggaagactagtgattttgttgtt

SEQ ID NO: 1168 - DNA, 21 bp, Homo sapiens
tcctgactccaggtcctgtgt

SEQ ID NO: 1169 - DNA, 20 bp, Homo sapiens
tgagaactgaattccatggg

SEQ ID NO: 1170 - DNA, 22 bp, Homo sapiens
tgattgacacttctgtgagtag

SEQ ID NO: 1171 - DNA, 22 bp, Homo sapiens
actctagagggaagcgctttct

SEQ ID NO: 1172 - DNA, 21 bp, Homo sapiens
tcaagagcaataacgaaaaat

SEQ ID NO: 1173 - DNA, 22 bp, Homo sapiens
ggagaaattatccttggtgtgt

SEQ ID NO: 1174 - DNA, 21 bp, Homo sapiens
tgattggtacgtctgtgggta

SEQ ID NO: 1175 - DNA, 23 bp, Homo sapiens
taatccttgctacctgggtgaga

SEQ ID NO: 1176 - DNA, 21 bp, Homo sapiens
ctgtacaaccttctagctttc

SEQ ID NO: 1177 - DNA, 21 bp, Homo sapiens
caaaacgtgaggcgctgctat

SEQ ID NO: 1178 - DNA, 18 bp, Homo sapiens
cataaagtagaaagcact

SEQ ID NO: 1179 - DNA, 22 bp, Homo sapiens
tcactcctctcctcccgtcttc

SEQ ID NO: 1180 - DNA, 21 bp, Homo sapiens
tgattgtagccttttggagta

SEQ ID NO: 1181 - DNA, 21 bp, Homo sapiens
ctgaagctcagagggctctga

SEQ ID NO: 1182 - DNA, 23 bp, Homo sapiens
gaaaagctgggttgagagggcga

SEQ ID NO: 1183 - DNA, 25 bp, Homo sapiens
tattgcacttgtcccggcctgttga

SEQ ID NO: 1184 - DNA, 21 bp, Homo sapiens
gttctcccaacgtaagcccag

SEQ ID NO: 1185 - DNA, 26 bp, Homo sapiens
ttaatgctaatcgtgataggggtttt

SEQ ID NO: 1186 - DNA, 23 bp, Homo sapiens
atgcagtccatgggcatatacac

SEQ ID NO: 1187 - DNA, 21 bp, Homo sapiens
tcggatccgtctgagcttggc

SEQ ID NO: 1188 - DNA, 22 bp, Homo sapiens
tcaaagtgcttacagtgcaggt

SEQ ID NO: 1189 - DNA, 22 bp, Homo sapiens
tgaaggtctactgtgtgccagg

SEQ ID NO: 1190 - DNA, 23 bp, Homo sapiens
accgatttctcctggtgttcaga

SEQ ID NO: 1191 - DNA, 18 bp, Homo sapiens
tgaggtaggaggttgtat

SEQ ID NO: 1192 - DNA, 21 bp, Homo sapiens
agaattgtggctggacatctg

SEQ ID NO: 1193 - DNA, 22 bp, Homo sapiens
ttacagttgttcaaccagttac

SEQ ID NO: 1194 - DNA, 22 bp, Homo sapiens
atagtagaccgtatagcgtacg

SEQ ID NO: 1195 - DNA, 22 bp, Homo sapiens
gtgaaatgtttaggaccactag

SEQ ID NO: 1196 - DNA, 21 bp, Homo sapiens
actagattgtgagctcctgga

SEQ ID NO: 1197 - DNA, 20 bp, Homo sapiens
tgattgtagccttttggagt

SEQ ID NO: 1198 - DNA, 24 bp, Homo sapiens
gtgaacgggcgccatcccgaggct

SEQ ID NO: 1199 - DNA, 23 bp, Homo sapiens
ggagaaattatccttggtgtgtt

SEQ ID NO: 1200 - DNA, 29 bp, Homo sapiens
cgtgtatttgacaagctgagttggacact

SEQ ID NO: 1201 - DNA, 22 bp, Homo sapiens
tactgcagacgtggcaatcatg

SEQ ID NO: 1202 - DNA, 23 bp, Homo sapiens
ttgattgacacttctgtgagtag

SEQ ID NO: 1203 - DNA, 23 bp, Homo sapiens
ctcttgagggaagcactttctgt

SEQ ID NO: 1204 - DNA, 24 bp, Homo sapiens
ctagcaccatctgaaatcggttat

SEQ ID NO: 1205 - DNA, 22 bp, Homo sapiens
ataatacatggttaacctcttt

SEQ ID NO: 1206 - DNA, 22 bp, Homo sapiens
gcctgctggggtggaacctggt

SEQ ID NO: 1207 - DNA, 20 bp, Homo sapiens
tgtaaacatcctcgactgga

SEQ ID NO: 1208 - DNA, 24 bp, Homo sapiens
ttccctttgtcatccttcgcctag

SEQ ID NO: 1209 - DNA, 21 bp, Homo sapiens
tcactcctctcctcccgtctt

SEQ ID NO: 1210 - DNA, 22 bp, Homo sapiens
gtgaacgggcgccatcccgagg

SEQ ID NO: 1211 - DNA, 23 bp, Homo sapiens
tagtgcaatattgcttatagggt

SEQ ID NO: 1212 - DNA, 23 bp, Homo sapiens
actgcattatgagcacttaaagt

SEQ ID NO: 1213 - DNA, 22 bp, Homo sapiens
ttaatgctaatcgtgatagggg

SEQ ID NO: 1214 - DNA, 21 bp, Homo sapiens
gcctgctggggtggaacctgg

SEQ ID NO: 1215 - DNA, 24 bp, Homo sapiens
gctggtttcatatggtggtttaga

SEQ ID NO: 1216 - DNA, 22 bp, Homo sapiens
catcatcgtctcaaatgagtct

SEQ ID NO: 1217 - DNA, 23 bp, Homo sapiens
cctcccacacccaaggcttgcaa

SEQ ID NO: 1218 - DNA, 21 bp, Homo sapiens
ctgcagtgaaggcacttgtag

SEQ ID NO: 1219 - DNA, 22 bp, Homo sapiens
aaacaaacatggtgcacttctt

SEQ ID NO: 1220 - DNA, 24 bp, Homo sapiens
tattgcacttgtcccggcctgtgg

SEQ ID NO: 1221 - DNA, 23 bp, Homo sapiens
atcacaagtcaggctcttgggac

SEQ ID NO: 1222 - DNA, 22 bp, Homo sapiens
gattgtagccttttggagtaga

SEQ ID NO: 1223 - DNA, 22 bp, Homo sapiens
aatcacattgccagggatttcc

SEQ ID NO: 1224 - DNA, 21 bp, Homo sapiens
actctttccctgttgcactac

SEQ ID NO: 1225 - DNA, 23 bp, Homo sapiens
tggagagaaaggcagttcctgat

SEQ ID NO: 1226 - DNA, 23 bp, Homo sapiens
ggatatcatcatatactgtaagt

SEQ ID NO: 1227 - DNA, 22 bp, Homo sapiens
aatcatacacggttgacctatt

SEQ ID NO: 1228 - DNA, 20 bp, Homo sapiens
tacagtatagatgatgtact

SEQ ID NO: 1229 - DNA, 21 bp, Homo sapiens
aacagtctacagccatggtcg

SEQ ID NO: 1230 - DNA, 22 bp, Homo sapiens
gtaaggcacccttctgagtaga

SEQ ID NO: 1231 - DNA, 22 bp, Homo sapiens
ggactccatttgttttgatgat

SEQ ID NO: 1232 - DNA, 21 bp, Homo sapiens
tgtgacagattgataactgaa

SEQ ID NO: 1233 - DNA, 24 bp, Homo sapiens
ttgcaggtcgtcttgcagggcttc

SEQ ID NO: 1234 - DNA, 22 bp, Homo sapiens
acagcaggcacagacaggcagt

SEQ ID NO: 1235 - DNA, 21 bp, Homo sapiens
cactcctctcctcccgtcttc

SEQ ID NO: 1236 - DNA, 21 bp, Homo sapiens
cacagggtagaaccacggaca

SEQ ID NO: 1237 - DNA, 22 bp, Homo sapiens
gctctgactttattgcactact

SEQ ID NO: 1238 - DNA, 20 bp, Homo sapiens
gtcagtttgtcaaatacccc

SEQ ID NO: 1239 - DNA, 20 bp, Homo sapiens
atataatacaacctgctaag

SEQ ID NO: 1240 - DNA, 22 bp, Homo sapiens
tcagttatcacagtgctgatgc

SEQ ID NO: 1241 - DNA, 22 bp, Homo sapiens
ttatcagactgatgttgactgt

SEQ ID NO: 1242 - DNA, 20 bp, Homo sapiens
agaggtagtaggttgcatag

SEQ ID NO: 1243 - DNA, 23 bp, Homo sapiens
atgaggtagtaggttgtatagtt

SEQ ID NO: 1244 - DNA, 20 bp, Homo sapiens
aggggctggctttcctctgg

SEQ ID NO: 1245 - DNA, 22 bp, Homo sapiens
ttcctatgcatatacttctttg

SEQ ID NO: 1246 - DNA, 24 bp, Homo sapiens
accctgtagaaccgaatttgtgtg

SEQ ID NO: 1247 - DNA, 21 bp, Homo sapiens
tccctgagaccctttaacctg

SEQ ID NO: 1248 - DNA, 22 bp, Homo sapiens
taaacgtggatgtacttgcttt

SEQ ID NO: 1249 - DNA, 22 bp, Homo sapiens
gacctctgaaattcagttcttc

SEQ ID NO: 1250 - DNA, 21 bp, Homo sapiens
caacaaatcacagtctgccat

SEQ ID NO: 1251 - DNA, 21 bp, Homo sapiens
tgggtttacgttgggagaact

SEQ ID NO: 1252 - DNA, 22 bp, Homo sapiens
tcacagtgaaccggtctctttc

SEQ ID NO: 1253 - DNA, 21 bp, Homo sapiens
taagtgcttccatgttttagt

SEQ ID NO: 1254 - DNA, 22 bp, Homo sapiens
taagtgcttccatgttttagta

SEQ ID NO: 1255 - DNA, 21 bp, Homo sapiens
tgaaggtctactgtgtgccag

SEQ ID NO: 1256 - DNA, 26 bp, Homo sapiens
aatccttggaacctaggtgtgagtgc

SEQ ID NO: 1257 - DNA, 24 bp, Homo sapiens
agacgggaggaaagaagggagtgg

SEQ ID NO: 1258 - DNA, 20 bp, Homo sapiens
ttcctatgcatatacttctt

SEQ ID NO: 1259 - DNA, 22 bp, Homo sapiens
tctctcggctcctcgcggctcg

SEQ ID NO: 1260 - DNA, 20 bp, Homo sapiens
cacgctcatgcacacaccca

SEQ ID NO: 1261 - DNA, 17 bp, Homo sapiens
tcgtaccgtgagtaata

SEQ ID NO: 1262 - DNA, 24 bp, Homo sapiens
accacagggtagaaccacggacag

SEQ ID NO: 1263 - DNA, 23 bp, Homo sapiens
aaacaaacatggtgcacttcttt

SEQ ID NO: 1264 - DNA, 22 bp, Homo sapiens
cagttaccgcttccgctaccgc

SEQ ID NO: 1265 - DNA, 20 bp, Homo sapiens
tagcagcacataatggtttg

SEQ ID NO: 1266 - DNA, 22 bp, Homo sapiens
taggttatccgtgttgccttcg

SEQ ID NO: 1267 - DNA, 21 bp, Homo sapiens
tccctgtcctccaggagctca

SEQ ID NO: 1268 - DNA, 19 bp, Homo sapiens
tgtaaacatccccgactgg

SEQ ID NO: 1269 - DNA, 21 bp, Homo sapiens
cgtcaacacttgctggtttcc

SEQ ID NO: 1270 - DNA, 19 bp, Homo sapiens
atcacattgccagggattt

SEQ ID NO: 1271 - DNA, 20 bp, Homo sapiens
taagtgcttccatgttttag

SEQ ID NO: 1272 - DNA, 21 bp, Homo sapiens
tggacggagaactgataaggg

SEQ ID NO: 1273 - DNA, 20 bp, Homo sapiens
tggtagactatggaacgtag

SEQ ID NO: 1274 - DNA, 19 bp, Homo sapiens
taacagtctccagtcacgg

SEQ ID NO: 1275 - DNA, 20 bp, Homo sapiens
attggtacgtctgtgggtag

SEQ ID NO: 1276 - DNA, 23 bp, Homo sapiens
aagtgccgccatcttttgagtgt

SEQ ID NO: 1277 - DNA, 22 bp, Homo sapiens
catatgtctgctgaccatcacc

SEQ ID NO: 1278 - DNA, 21 bp, Homo sapiens
ctgagatgaagcactgtagct

SEQ ID NO: 1279 - DNA, 24 bp, Homo sapiens
actcggcgtggcgtcggtcgtggt

SEQ ID NO: 1280 - DNA, 21 bp, Homo sapiens
gctctgactttattgcactac

SEQ ID NO: 1281 - DNA, 21 bp, Homo sapiens
ccacctcccctgcaaacgtcc

SEQ ID NO: 1282 - DNA, 22 bp, Homo sapiens
tccgtctcagttactttatagc

SEQ ID NO: 1283 - DNA, 22 bp, Homo sapiens
tcaacacttgctggtttcctct

SEQ ID NO: 1284 - DNA, 20 bp, Homo sapiens
tttcagtcggatgtttgcag

SEQ ID NO: 1285 - DNA, 22 bp, Homo sapiens
aagtgccgccatcttttgagtg

SEQ ID NO: 1286 - DNA, 23 bp, Homo sapiens
actcaaactgtgggggcactttc

SEQ ID NO: 1287 - DNA, 20 bp, Homo sapiens
gaagtgcttcgattttgggg

SEQ ID NO: 1288 - DNA, 20 bp, Homo sapiens
attgtagccttttggagtag

SEQ ID NO: 1289 - DNA, 21 bp, Homo sapiens
actcaaactgtgggggcactt

SEQ ID NO: 1290 - DNA, 21 bp, Homo sapiens
tgtaacagcaactccatgtgg

SEQ ID NO: 1291 - DNA, 21 bp, Homo sapiens
cgcatcccctagggcattggt

SEQ ID NO: 1292 - DNA, 22 bp, Homo sapiens
ttaatatcggacaaccattgtt

SEQ ID NO: 1293 - DNA, 18 bp, Homo sapiens
tgtaaacatcctcgactg

SEQ ID NO: 1294 - DNA, 23 bp, Homo sapiens
taaagtgctgacagtgcagatag

SEQ ID NO: 1295 - DNA, 20 bp, Homo sapiens
tctcccaacccttgtaccag

SEQ ID NO: 1296 - DNA, 23 bp, Homo sapiens
tgctgaagctcagagggctctga

SEQ ID NO: 1297 - DNA, 22 bp, Homo sapiens
aatgcacctgggcaaggattca

SEQ ID NO: 1298 - DNA, 25 bp, Homo sapiens
aaaagctgggttgagagggcgaaaa

SEQ ID NO: 1299 - DNA, 21 bp, Homo sapiens
ctggctcagttcagcaggaac

SEQ ID NO: 1300 - DNA, 23 bp, Homo sapiens
agaactgaattccatgggttgtg

SEQ ID NO: 1301 - DNA, 21 bp, Homo sapiens
ttgtacatggtaggctttcat

SEQ ID NO: 1302 - DNA, 21 bp, Homo sapiens
ctcctatatgatgcctttctt

SEQ ID NO: 1303 - DNA, 20 bp, Homo sapiens
tcactcctctcctcccgtct

SEQ ID NO: 1304 - DNA, 23 bp, Homo sapiens
gcagtgcaatgttaaaagggcat

SEQ ID NO: 1305 - DNA, 19 bp, Homo sapiens
ccgcactgtgggtacttgc

SEQ ID NO: 1306 - DNA, 23 bp, Homo sapiens
tctctgggcctgtgtcttaggct

SEQ ID NO: 1307 - DNA, 21 bp, Homo sapiens
gtaaacatccttgactggaag

SEQ ID NO: 1308 - DNA, 20 bp, Homo sapiens
aacaatatcctggtgctgag

SEQ ID NO: 1309 - DNA, 21 bp, Homo sapiens
taagtgcttccatgtttgagt

SEQ ID NO: 1310 - DNA, 22 bp, Homo sapiens
tgagaactgaattccatgggtt

SEQ ID NO: 1311 - DNA, 21 bp, Homo sapiens
atgcagtccatgggcatatac

SEQ ID NO: 1312 - DNA, 23 bp, Homo sapiens
ttcctatgcatatacttctttga

SEQ ID NO: 1313 - DNA, 22 bp, Homo sapiens
tcttctctgttttggccatgtg

SEQ ID NO: 1314 - DNA, 22 bp, Homo sapiens
atactgtaaacgctttctgatg

SEQ ID NO: 1315 - DNA, 21 bp, Homo sapiens
ctgccctggcccgagggaccg

SEQ ID NO: 1316 - DNA, 23 bp, Homo sapiens
ggtgcagtgctgcatctctggtc

SEQ ID NO: 1317 - DNA, 22 bp, Homo sapiens
tatgtctgctgaccatcacctt

SEQ ID NO: 1318 - DNA, 19 bp, Homo sapiens
aaaccgttaccattactga

SEQ ID NO: 1319 - DNA, 22 bp, Homo sapiens
ggatatcatcatatactgtaag

SEQ ID NO: 1320 - DNA, 21 bp, Homo sapiens
caaagaattctccttttgggc

SEQ ID NO: 1321 - DNA, 23 bp, Homo sapiens
tgaaacatacacgggaaacctct

SEQ ID NO: 1322 - DNA, 22 bp, Homo sapiens
atataatacaacctgctaagtg

SEQ ID NO: 1323 - DNA, 24 bp, Homo sapiens
aatgcacccgggcaaggattctga

SEQ ID NO: 1324 - DNA, 22 bp, Homo sapiens
tctcacacagaaatcgcacccg

SEQ ID NO: 1325 - DNA, 21 bp, Homo sapiens
tgatatgtttgatatattagg

SEQ ID NO: 1326 - DNA, 22 bp, Homo sapiens
acagtagtctgcacattggtta

SEQ ID NO: 1327 - DNA, 23 bp, Homo sapiens
tcggatccgtctgagcttggctg

SEQ ID NO: 1328 - DNA, 22 bp, Homo sapiens
caagctcgcttctatgggtctg

SEQ ID NO: 1329 - DNA, 20 bp, Homo sapiens
aactggttgaacaactgaac

SEQ ID NO: 1330 - DNA, 22 bp, Homo sapiens
ttctcaaggaggtgtcgtttat

SEQ ID NO: 1331 - DNA, 21 bp, Homo sapiens
aagttgttcgtggtggattcg

SEQ ID NO: 1332 - DNA, 24 bp, Homo sapiens
aacattcattgttgtcggtgggtt

SEQ ID NO: 1333 - DNA, 22 bp, Homo sapiens
tgcaccatggttgtctgagcat

SEQ ID NO: 1334 - DNA, 19 bp, Homo sapiens
tggctcagttcagcaggaa

SEQ ID NO: 1335 - DNA, 23 bp, Homo sapiens
ttgtgcaaatctatgcaaaactg

SEQ ID NO: 1336 - DNA, 22 bp, Homo sapiens
aatcgtacagggtcatccactt

SEQ ID NO: 1337 - DNA, 21 bp, Homo sapiens
acagcaggcacagacaggcag

SEQ ID NO: 1338 - DNA, 22 bp, Homo sapiens
gccctgtggactcagttctggt

SEQ ID NO: 1339 - DNA, 22 bp, Homo sapiens
aagtgctgtcatagctgaggtc

SEQ ID NO: 1340 - DNA, 22 bp, Homo sapiens
cctattcttgattacttgtttc

SEQ ID NO: 1341 - DNA, 22 bp, Homo sapiens
aaccgttaccattactgagttt

SEQ ID NO: 1342 - DNA, 24 bp, Homo sapiens
ttgcagctgcctgggagtgacttc

SEQ ID NO: 1343 - DNA, 22 bp, Homo sapiens
gtccctctccaaatgtgtcttg

SEQ ID NO: 1344 - DNA, 19 bp, Homo sapiens
tgagaactgaattccatgg

SEQ ID NO: 1345 - DNA, 24 bp, Homo sapiens
tcaaagtgcttacagtgcaggtag

SEQ ID NO: 1346 - DNA, 22 bp, Homo sapiens
tgtgactggttgaccagagggg

SEQ ID NO: 1347 - DNA, 17 bp, Homo sapiens
taccctgtagatccgaa

SEQ ID NO: 1348 - DNA, 18 bp, Homo sapiens
tgtaaacatccttgactg

SEQ ID NO: 1349 - DNA, 22 bp, Homo sapiens
aaggagctcacagtctattgag

SEQ ID NO: 1350 - DNA, 23 bp, Homo sapiens
actgtagtatgggcacttccagt

SEQ ID NO: 1351 - DNA, 17 bp, Homo sapiens
cattgcacttgtctcgg

SEQ ID NO: 1352 - DNA, 24 bp, Homo sapiens
agctacattgtctgctgggtttca

SEQ ID NO: 1353 - DNA, 21 bp, Homo sapiens
aatcgtacagggtcatccact

SEQ ID NO: 1354 - DNA, 24 bp, Homo sapiens
ctcgaggagctcacagtctagtat

SEQ ID NO: 1355 - DNA, 23 bp, Homo sapiens
aggttacccgagcaactttgcat

SEQ ID NO: 1356 - DNA, 21 bp, Homo sapiens
aagtgctgttcgtgcaggtag

SEQ ID NO: 1357 - DNA, 21 bp, Homo sapiens
tgtaaacatcctacactctca

SEQ ID NO: 1358 - DNA, 22 bp, Homo sapiens
tcccccaggtgtgattctgatt

SEQ ID NO: 1359 - DNA, 21 bp, Homo sapiens
taactggttgaacaactgaac

SEQ ID NO: 1360 - DNA, 24 bp, Homo sapiens
ttgtgcaaatctatgcaaaactga

SEQ ID NO: 1361 - DNA, 23 bp, Homo sapiens
tccctgagaccctaacttgtgat

SEQ ID NO: 1362 - DNA, 25 bp, Homo sapiens
atgatactgtaaacgctttctgatg

SEQ ID NO: 1363 - DNA, 22 bp, Homo sapiens
agatcgaccgtgttatattcgc

SEQ ID NO: 1364 - DNA, 24 bp, Homo sapiens
aggaagccctggaggggctggagg

SEQ ID NO: 1365 - DNA, 23 bp, Homo sapiens
ctttcagtcagatgtttgctgct

SEQ ID NO: 1366 - DNA, 20 bp, Homo sapiens
ctagcaccatctgaaatcgg

SEQ ID NO: 1367 - DNA, 22 bp, Homo sapiens
caacattcattgctgtcggtgg

SEQ ID NO: 1368 - DNA, 23 bp, Homo sapiens
tctctcggctcctcgcggctcgc

SEQ ID NO: 1369 - DNA, 24 bp, Homo sapiens
aggttacccgagcaactttgcatc

SEQ ID NO: 1370 - DNA, 21 bp, Homo sapiens
aatgcacctgggcaaggattc

SEQ ID NO: 1371 - DNA, 20 bp, Homo sapiens
aaatgctcagactcctgtgg

SEQ ID NO: 1372 - DNA, 21 bp, Homo sapiens
tgccctggcccgagggaccga

SEQ ID NO: 1373 - DNA, 20 bp, Homo sapiens
tgcaacgaacctgagccact

SEQ ID NO: 1374 - DNA, 22 bp, Homo sapiens
cagtgcaatgttaaaagggcat

SEQ ID NO: 1375 - DNA, 22 bp, Homo sapiens
cagtggttttaccctatggtag

SEQ ID NO: 1376 - DNA, 22 bp, Homo sapiens
cagtagtctgcacattggttag

SEQ ID NO: 1377 - DNA, 21 bp, Homo sapiens
caggtcgtcttgcagggcttc

SEQ ID NO: 1378 - DNA, 20 bp, Homo sapiens
ccacagggtagaaccacgga

SEQ ID NO: 1379 - DNA, 24 bp, Homo sapiens
tcccccaggtgtgattctgatttg

SEQ ID NO: 1380 - DNA, 21 bp, Homo sapiens
cagtggttttaccctatggta

SEQ ID NO: 1381 - DNA, 18 bp, Homo sapiens
ttcaagtaatccaggata

SEQ ID NO: 1382 - DNA, 24 bp, Homo sapiens
aacattcaacctgtcggtgagttt

SEQ ID NO: 1383 - DNA, 20 bp, Homo sapiens
caacggaatcccaaaagcag

SEQ ID NO: 1384 - DNA, 21 bp, Homo sapiens
tccgagcctgggtctccctct

SEQ ID NO: 1385 - DNA, 21 bp, Homo sapiens
tccctgagaccctaacttgtg

SEQ ID NO: 1386 - DNA, 19 bp, Homo sapiens
ctagactgaagctccttga

SEQ ID NO: 1387 - DNA, 24 bp, Homo sapiens
tggcagtgtcttagctggttgttg

SEQ ID NO: 1388 - DNA, 21 bp, Homo sapiens
tctcccaacccttgtaccagt

SEQ ID NO: 1389 - DNA, 22 bp, Homo sapiens
ggcagtgtcttagctggttgtt

SEQ ID NO: 1390 - DNA, 23 bp, Homo sapiens
tattgcacttgtcccggcctgtg

SEQ ID NO: 1391 - DNA, 21 bp, Homo sapiens
agaggtatagggcatgggaaa

SEQ ID NO: 1392 - DNA, 24 bp, Homo sapiens
tccctgagaccctttaacctgtga

SEQ ID NO: 1393 - DNA, 21 bp, Homo sapiens
actccagccccacagcctcag

SEQ ID NO: 1394 - DNA, 22 bp, Homo sapiens
tgcagtccatgggcatatacac

SEQ ID NO: 1395 - DNA, 24 bp, Homo sapiens
aacccgtagatccgaacttgtggt

SEQ ID NO: 1396 - DNA, 20 bp, Homo sapiens
aaagctgggttgagagggcg

SEQ ID NO: 1397 - DNA, 21 bp, Homo sapiens
gaggtagtaggttgcatagtt

SEQ ID NO: 1398 - DNA, 19 bp, Homo sapiens
ttaatgctaatcgtgatag

SEQ ID NO: 1399 - DNA, 19 bp, Homo sapiens
ttcaagtaattcaggatag

SEQ ID NO: 1400 - DNA, 22 bp, Homo sapiens
aatcattcacggacaacacttt

SEQ ID NO: 1401 - DNA, 22 bp, Homo sapiens
catcgggaatgtcgtgtccgcc

SEQ ID NO: 1402 - DNA, 22 bp, Homo sapiens
tctcactgtagcctcgaacccc

SEQ ID NO: 1403 - DNA, 22 bp, Homo sapiens
aaacccgtagatccgaacttgt

SEQ ID NO: 1404 - DNA, 22 bp, Homo sapiens
ctggacttggagtcagaaggcc

SEQ ID NO: 1405 - DNA, 23 bp, Homo sapiens
tctcacacagaaatcgcacccgt

SEQ ID NO: 1406 - DNA, 22 bp, Homo sapiens
atgcacccgggcaaggattctg

SEQ ID NO: 1407 - DNA, 20 bp, Homo sapiens
ggtgcagtgctgcatctctg

SEQ ID NO: 1408 - DNA, 19 bp, Homo sapiens
ttgttcgttcggctcgcgt

SEQ ID NO: 1409 - DNA, 22 bp, Homo sapiens
cactgtgtcctttctgcgtaga

SEQ ID NO: 1410 - DNA, 22 bp, Homo sapiens
tcttggagtaggtcattgggtg

SEQ ID NO: 1411 - DNA, 19 bp, Homo sapiens
caacggaatcccaaaagca

SEQ ID NO: 1412 - DNA, 23 bp, Homo sapiens
aatgcacctgggcaaggattcag

SEQ ID NO: 1413 - DNA, 19 bp, Homo sapiens
tgtgactggttgaccagag

SEQ ID NO: 1414 - DNA, 22 bp, Homo sapiens
tacagttgttcaaccagttact

SEQ ID NO: 1415 - DNA, 20 bp, Homo sapiens
agcagcattgtacagggcta

SEQ ID NO: 1416 - DNA, 22 bp, Homo sapiens
aaagtgctgttcgtgcaggtag

SEQ ID NO: 1417 - DNA, 19 bp, Homo sapiens
tctcccaacccttgtacca

SEQ ID NO: 1418 - DNA, 24 bp, Homo sapiens
acccagtgttcagactacctgttc

SEQ ID NO: 1419 - DNA, 20 bp, Homo sapiens
aaaagctgggttgagagggc

SEQ ID NO: 1420 - DNA, 21 bp, Homo sapiens
tgtaaacatccttgactggaa

SEQ ID NO: 1421 - DNA, 24 bp, Homo sapiens
tcttggagtaggtcattgggtgga

SEQ ID NO: 1422 - DNA, 22 bp, Homo sapiens
aggcagtgtagttagctgattg

SEQ ID NO: 1423 - DNA, 18 bp, Homo sapiens
tcagtgcactacagaact

SEQ ID NO: 1424 - DNA, 21 bp, Homo sapiens
ctccgtttgcctgtttcgctg

SEQ ID NO: 1425 - DNA, 20 bp, Homo sapiens
tgtgcaaatccatgcaaaac

SEQ ID NO: 1426 - DNA, 20 bp, Homo sapiens
tagcaccatttgaaatcggt

SEQ ID NO: 1427 - DNA, 22 bp, Homo sapiens
tgctatgccaacatattgccat

SEQ ID NO: 1428 - DNA, 21 bp, Homo sapiens
ttttgcgatgtgttcctaata

SEQ ID NO: 1429 - DNA, 18 bp, Homo sapiens
tagcaccatttgaaatcg

SEQ ID NO: 1430 - DNA, 20 bp, Homo sapiens
cacattgccagggatttcca

SEQ ID NO: 1431 - DNA, 23 bp, Homo sapiens
caacctggaggactccatgctgt

SEQ ID NO: 1432 - DNA, 22 bp, Homo sapiens
aggttgggatcggttgcaatgc

SEQ ID NO: 1433 - DNA, 20 bp, Homo sapiens
tggcactggtagaattcact

SEQ ID NO: 1434 - DNA, 25 bp, Homo sapiens
caagtcactagtggttccgtttagt

SEQ ID NO: 1435 - DNA, 21 bp, Homo sapiens
tatggctttttattcctatgt

SEQ ID NO: 1436 - DNA, 22 bp, Homo sapiens
atggcactggtagaattcactg

SEQ ID NO: 1437 - DNA, 22 bp, Homo sapiens
tcctgtactgagctgccccgag

SEQ ID NO: 1438 - DNA, 20 bp, Homo sapiens
ttgtgacagattgataactg

SEQ ID NO: 1439 - DNA, 21 bp, Homo sapiens
taaggcacgcggtgaatgcca

SEQ ID NO: 1440 - DNA, 19 bp, Homo sapiens
agcagcattgtacagggct

SEQ ID NO: 1441 - DNA, 22 bp, Homo sapiens
ccagcatcagtgattttgttga

SEQ ID NO: 1442 - DNA, 18 bp, Homo sapiens
aatggtagaactcacact

SEQ ID NO: 1443 - DNA, 22 bp, Homo sapiens
gtcagtgcactacagaactttg

SEQ ID NO: 1444 - DNA, 21 bp, Homo sapiens
caatggtagaactcacactgg

SEQ ID NO: 1445 - DNA, 25 bp, Homo sapiens
ttggcaatggtagaactcacactgg

SEQ ID NO: 1446 - DNA, 20 bp, Homo sapiens
cttatcagattgtattgtaa

SEQ ID NO: 1447 - DNA, 23 bp, Homo sapiens
gtagcttatcagactgatgttga

SEQ ID NO: 1448 - DNA, 21 bp, Homo sapiens
tgagatgaagcactgtagctc

SEQ ID NO: 1449 - DNA, 18 bp, Homo sapiens
tattgcactcgtcccggc

SEQ ID NO: 1450 - DNA, 22 bp, Homo sapiens
aacgccattatcacactaaata

SEQ ID NO: 1451 - DNA, 21 bp, Homo sapiens
gtagtgtttcctactttatgg

SEQ ID NO: 1452 - DNA, 22 bp, Homo sapiens
ctttcagtcagatgtttgctgc

SEQ ID NO: 1453 - DNA, 23 bp, Homo sapiens
ctgagaactgaattccataggct

SEQ ID NO: 1454 - DNA, 18 bp, Homo sapiens
cattgtacagggctatga

SEQ ID NO: 1455 - DNA, 18 bp, Homo sapiens
tgtaaacatcctacactc

SEQ ID NO: 1456 - DNA, 22 bp, Homo sapiens
ctgacctatgaattgacagcca

SEQ ID NO: 1457 - DNA, 21 bp, Homo sapiens
cactgtgtcctttctgcgtag

SEQ ID NO: 1458 - DNA, 22 bp, Homo sapiens
ttctcgaggaaagaagcacttt

SEQ ID NO: 1459 - DNA, 22 bp, Homo sapiens
gtgtcttttgctctgcagtcag

SEQ ID NO: 1460 - DNA, 21 bp, Homo sapiens
aagctgggttgagagggcgaa

SEQ ID NO: 1461 - DNA, 18 bp, Homo sapiens
tatggcactggtagaatt

SEQ ID NO: 1462 - DNA, 22 bp, Homo sapiens
tcaacaaaatcactgatgctgg

SEQ ID NO: 1463 - DNA, 19 bp, Homo sapiens
ttcctatgcatatacttct

SEQ ID NO: 1464 - DNA, 21 bp, Homo sapiens
gtgcctactgagctgaaacac

SEQ ID NO: 1465 - DNA, 23 bp, Homo sapiens
atgaggtagtagattgtatagtt

SEQ ID NO: 1466 - DNA, 21 bp, Homo sapiens
ctcgtgggctctggccacggc

SEQ ID NO: 1467 - DNA, 20 bp, Homo sapiens
acattcaacgctgtcggtga

SEQ ID NO: 1468 - DNA, 21 bp, Homo sapiens
ggatatcatcatatactgtaa

SEQ ID NO: 1469 - DNA, 19 bp, Homo sapiens
tcgaccggacctcgaccgg

SEQ ID NO: 1470 - DNA, 19 bp, Homo sapiens
taatactgcctggtaatga

SEQ ID NO: 1471 - DNA, 21 bp, Homo sapiens
ctcctacatattagcattaac

SEQ ID NO: 1472 - DNA, 20 bp, Homo sapiens
cccaatacacggtcgacctc

SEQ ID NO: 1473 - DNA, 20 bp, Homo sapiens
ctccctgggctctgcctccc

SEQ ID NO: 1474 - DNA, 19 bp, Homo sapiens
tagcaccatttgaaatcgg

SEQ ID NO: 1475 - DNA, 23 bp, Homo sapiens
ctggctcagttcagcaggaacag

SEQ ID NO: 1476 - DNA, 19 bp, Homo sapiens
tcttggagtaggtcattgg

SEQ ID NO: 1477 - DNA, 22 bp, Homo sapiens
tgagtaccgccatgtctgttgg

SEQ ID NO: 1478 - DNA, 23 bp, Homo sapiens
atcagggcttgtggaatgggaag

SEQ ID NO: 1479 - DNA, 22 bp, Homo sapiens
gatatcatcatatactgtaagt

SEQ ID NO: 1480 - DNA, 19 bp, Homo sapiens
tgttcagaaagtctgttgt

SEQ ID NO: 1481 - DNA, 21 bp, Homo sapiens
ccctgtggactcagttctggt

SEQ ID NO: 1482 - DNA, 24 bp, Homo sapiens
tgtatggcactggtagaattcact

SEQ ID NO: 1483 - DNA, 21 bp, Homo sapiens
ggattcctggaaatactgttc

SEQ ID NO: 1484 - DNA, 22 bp, Homo sapiens
tggcactggtagaattcactgt

SEQ ID NO: 1485 - DNA, 22 bp, Homo sapiens
ttggcaatggtagaactcacac

SEQ ID NO: 1486 - DNA, 19 bp, Homo sapiens
tacagtatagatgatgtac

SEQ ID NO: 1487 - DNA, 23 bp, Homo sapiens
tgaggggcagagagcgagacttt

SEQ ID NO: 1488 - DNA, 23 bp, Homo sapiens
ctctggagggaagcactttctgt

SEQ ID NO: 1489 - DNA, 20 bp, Homo sapiens
tcctatatgatgcctttctt

SEQ ID NO: 1490 - DNA, 19 bp, Homo sapiens
tccagcatcagtgattttg

SEQ ID NO: 1491 - DNA, 23 bp, Homo sapiens
aggggtgctatctgtgattgagg

SEQ ID NO: 1492 - DNA, 24 bp, Homo sapiens
cccagtgtttagactatctgttca

SEQ ID NO: 1493 - DNA, 19 bp, Homo sapiens
cgaatcattatttgctgct

SEQ ID NO: 1494 - DNA, 21 bp, Homo sapiens
cagttaccgcttccgctaccg

SEQ ID NO: 1495 - DNA, 19 bp, Homo sapiens
accacagggtagaaccacg

SEQ ID NO: 1496 - DNA, 21 bp, Homo sapiens
tatgtgcctttggactacatc

SEQ ID NO: 1497 - DNA, 20 bp, Homo sapiens
tgcaccatggttgtctgagc

SEQ ID NO: 1498 - DNA, 20 bp, Homo sapiens
ctcctgactccaggtcctgt

SEQ ID NO: 1499 - DNA, 20 bp, Homo sapiens
gaaatgtttaggaccactag

SEQ ID NO: 1500 - DNA, 19 bp, Homo sapiens
actgaattccataggctgt

SEQ ID NO: 1501 - DNA, 23 bp, Homo sapiens
tgattgtccaaacgcaattcttg

SEQ ID NO: 1502 - DNA, 19 bp, Homo sapiens
tgcaacgaacctgagccac

SEQ ID NO: 1503 - DNA, 17 bp, Homo sapiens
atcacattgccagggat

SEQ ID NO: 1504 - DNA, 19 bp, Homo sapiens
cccgtagatccgaacttgt

SEQ ID NO: 1505 - DNA, 22 bp, Homo sapiens
tgtgcaaatccatgcaaaactg

SEQ ID NO: 1506 - DNA, 22 bp, Homo sapiens
gtagtgtttcctactttatgga

SEQ ID NO: 1507 - DNA, 21 bp, Homo sapiens
ttgtgtcaatatgcgatgatg

SEQ ID NO: 1508 - DNA, 16 bp, Homo sapiens
cattgcacttgtctcg

SEQ ID NO: 1509 - DNA, 20 bp, Homo sapiens
ttcaccaccttctccaccca

SEQ ID NO: 1510 - DNA, 21 bp, Homo sapiens
tagtagattgtatagttgtgg

SEQ ID NO: 1511 - DNA, 19 bp, Homo sapiens
tcacattgccagggattac

SEQ ID NO: 1512 - DNA, 21 bp, Homo sapiens
tttccggctcgcgtgggtgtg

SEQ ID NO: 1513 - DNA, 23 bp, Homo sapiens
agcttatcagactgatgttgact

SEQ ID NO: 1514 - DNA, 21 bp, Homo sapiens
cagtgcaatgatgaaagggca

SEQ ID NO: 1515 - DNA, 21 bp, Homo sapiens
aacattcaacgctgtcggtga

SEQ ID NO: 1516 - DNA, 21 bp, Homo sapiens
cggggccgtagcactgtctga

SEQ ID NO: 1517 - DNA, 20 bp, Homo sapiens
agctgccagttgaagaactg

SEQ ID NO: 1518 - DNA, 22 bp, Homo sapiens
aagaggtatagggcatgggaaa

SEQ ID NO: 1519 - DNA, 21 bp, Homo sapiens
tggtccccttcaaccagctgt

SEQ ID NO: 1520 - DNA, 23 bp, Homo sapiens
aacccgtagatccgatcttgtgg

SEQ ID NO: 1521 - DNA, 21 bp, Homo sapiens
aattattgtacatcggatgag

SEQ ID NO: 1522 - DNA, 22 bp, Homo sapiens
gtttttcattattgctcctgac

SEQ ID NO: 1523 - DNA, 21 bp, Homo sapiens
atgtagggatggaagccatga

SEQ ID NO: 1524 - DNA, 21 bp, Homo sapiens
tgtatggcactggtagaattc

SEQ ID NO: 1525 - DNA, 21 bp, Homo sapiens
gttcacagtggctaagttctg

SEQ ID NO: 1526 - DNA, 23 bp, Homo sapiens
taccgcactgtgggtacttgctg

SEQ ID NO: 1527 - DNA, 23 bp, Homo sapiens
aatcgtacagggtcatccacttt

SEQ ID NO: 1528 - DNA, 21 bp, Homo sapiens
tgattgtccaaacgcaattct

SEQ ID NO: 1529 - DNA, 18 bp, Homo sapiens
ctagactgaagctccttg

SEQ ID NO: 1530 - DNA, 20 bp, Homo sapiens
ttataatacaacctgataag

SEQ ID NO: 1531 - DNA, 20 bp, Homo sapiens
cgtcaacacttgctggtttc

SEQ ID NO: 1532 - DNA, 18 bp, Homo sapiens
agctacattgtctgctgg

SEQ ID NO: 1533 - DNA, 21 bp, Homo sapiens
ctgggagaaggctgtttactc

SEQ ID NO: 1534 - DNA, 26 bp, Homo sapiens
aaaccgttaccattactgagtttagt

SEQ ID NO: 1535 - DNA, 18 bp, Homo sapiens
ctgcgtctttgtgctttc

SEQ ID NO: 1536 - DNA, 20 bp, Homo sapiens
accactgaccgttgactgta

SEQ ID NO: 1537 - DNA, 20 bp, Homo sapiens
tgctgacatatttactagag

SEQ ID NO: 1538 - DNA, 22 bp, Homo sapiens
tcaccagccctgtgttccctag

SEQ ID NO: 1539 - DNA, 21 bp, Homo sapiens
ccactgaccgttgactgtacc

SEQ ID NO: 1540 - DNA, 17 bp, Homo sapiens
tgaggtagtagattgta

SEQ ID NO: 1541 - DNA, 23 bp, Homo sapiens
gtagattctccttctatgagtac

SEQ ID NO: 1542 - DNA, 22 bp, Homo sapiens
caaatgctcagactcctgtggt

SEQ ID NO: 1543 - DNA, 21 bp, Homo sapiens
aaagttctgagacactccgac

SEQ ID NO: 1544 - DNA, 20 bp, Homo sapiens
tgtaaacatccccgactgga

SEQ ID NO: 1545 - DNA, 22 bp, Homo sapiens
agctacattgtctgctgggttt

SEQ ID NO: 1546 - DNA, 23 bp, Homo sapiens
tttacgttgggagaacttttacg

SEQ ID NO: 1547 - DNA, 21 bp, Homo sapiens
ttcaccaccttctccacccag

SEQ ID NO: 1548 - DNA, 18 bp, Homo sapiens
gtccagttttcccaggaa

SEQ ID NO: 1549 - DNA, 18 bp, Homo sapiens
tcacattgccagggattt

SEQ ID NO: 1550 - DNA, 18 bp, Homo sapiens
tagcagcacatcatggtt

SEQ ID NO: 1551 - DNA, 20 bp, Homo sapiens
ctgaagctcagagggctctg

SEQ ID NO: 1552 - DNA, 21 bp, Homo sapiens
gaggtagtaggttgtatggtt

SEQ ID NO: 1553 - DNA, 20 bp, Homo sapiens
tttggtccccttcaaccagc

SEQ ID NO: 1554 - DNA, 21 bp, Homo sapiens
gctcagttcagcaggaacagg

SEQ ID NO: 1555 - DNA, 17 bp, Homo sapiens
accctgtagatccgaat

SEQ ID NO: 1556 - DNA, 21 bp, Homo sapiens
aaaagctgggttgagagggcg

SEQ ID NO: 1557 - DNA, 21 bp, Homo sapiens
tggtagactatggaacgtagg

SEQ ID NO: 1558 - DNA, 20 bp, Homo sapiens
agcaccatctgaaatcggtt

SEQ ID NO: 1559 - DNA, 24 bp, Homo sapiens
tgtaacagcaactccatgtggaag

SEQ ID NO: 1560 - DNA, 24 bp, Homo sapiens
tccagcatcagtgattttgttgaa

SEQ ID NO: 1561 - DNA, 23 bp, Homo sapiens
ctggagatatggaagagctgtgt

SEQ ID NO: 1562 - DNA, 21 bp, Homo sapiens
ttgagaactgaattccatggg

SEQ ID NO: 1563 - DNA, 21 bp, Homo sapiens
gcaccatttgaaatcagtgtt

SEQ ID NO: 1564 - DNA, 21 bp, Homo sapiens
tcgtaccgtgagtaataatgc

SEQ ID NO: 1565 - DNA, 24 bp, Homo sapiens
tccttcattccaccggagtctgtc

SEQ ID NO: 1566 - DNA, 21 bp, Homo sapiens
tggtcgaccagttggaaagta

SEQ ID NO: 1567 - DNA, 21 bp, Homo sapiens
aattgcactttagcaatggtg

SEQ ID NO: 1568 - DNA, 20 bp, Homo sapiens
gccctgtggactcagttctg

SEQ ID NO: 1569 - DNA, 23 bp, Homo sapiens
aggaagccctggaggggctggag

SEQ ID NO: 1570 - DNA, 21 bp, Homo sapiens
tactctggagagtgacaatca

SEQ ID NO: 1571 - DNA, 20 bp, Homo sapiens
tactagactgaagctccttg

SEQ ID NO: 1572 - DNA, 19 bp, Homo sapiens
atgttggcctagttctgtg

SEQ ID NO: 1573 - DNA, 18 bp, Homo sapiens
taacactgtctggtaacg

SEQ ID NO: 1574 - DNA, 20 bp, Homo sapiens
ttgttcagaaagtctgttgt

SEQ ID NO: 1575 - DNA, 20 bp, Homo sapiens
tggtcgaccagttggaaagt

SEQ ID NO: 1576 - DNA, 21 bp, Homo sapiens
aaggagctcacagtctattga

SEQ ID NO: 1577 - DNA, 21 bp, Homo sapiens
atccgcgctctgactctctgc

SEQ ID NO: 1578 - DNA, 22 bp, Homo sapiens
agcaccatttgaaatcagtgtt

SEQ ID NO: 1579 - DNA, 23 bp, Homo sapiens
tgtgcaaatccatgcaaaactga

SEQ ID NO: 1580 - DNA, 20 bp, Homo sapiens
ctagcaccatttgaaatcgg

SEQ ID NO: 1581 - DNA, 20 bp, Homo sapiens
actctagctgccaaaggcgc

SEQ ID NO: 1582 - DNA, 20 bp, Homo sapiens
gtaaacatcctcgactggaa

SEQ ID NO: 1583 - DNA, 21 bp, Homo sapiens
ctgtacagcctcctagctttc

SEQ ID NO: 1584 - DNA, 23 bp, Homo sapiens
tgtttaaccttttgcctgttggt

SEQ ID NO: 1585 - DNA, 21 bp, Homo sapiens
tgtttaaccttttgcctgttg

SEQ ID NO: 1586 - DNA, 18 bp, Homo sapiens
ggtagtaggttgtatagt

SEQ ID NO: 1587 - DNA, 20 bp, Homo sapiens
tggcagtgtcttagctggtt

SEQ ID NO: 1588 - DNA, 20 bp, Homo sapiens
aagctgggttgagagggcga

SEQ ID NO: 1589 - DNA, 24 bp, Homo sapiens
tacagtactgtgataactgaagaa

SEQ ID NO: 1590 - DNA, 17 bp, Homo sapiens
ttatcagactgatgttg

SEQ ID NO: 1591 - DNA, 17 bp, Homo sapiens
tgttgccagtctctagg

SEQ ID NO: 1592 - DNA, 17 bp, Homo sapiens
tatcagactgatgttga

SEQ ID NO: 1593 - DNA, 22 bp, Homo sapiens
tatggcactggtagaattcact

SEQ ID NO: 1594 - DNA, 21 bp, Homo sapiens
gaactgaattccataggctgt

SEQ ID NO: 1595 - DNA, 21 bp, Homo sapiens
ctcgtaccgtgagtaataatg

SEQ ID NO: 1596 - DNA, 23 bp, Homo sapiens
tcacagtgaaccggtctcttttt

SEQ ID NO: 1597 - DNA, 21 bp, Homo sapiens
aaaccgttaccattactgagt

SEQ ID NO: 1598 - DNA, 23 bp, Homo sapiens
tggtccccttcaaccagctgtag

SEQ ID NO: 1599 - DNA, 22 bp, Homo sapiens
ctggctcagttcagcaggaaca

SEQ ID NO: 1600 - DNA, 23 bp, Homo sapiens
tgaggtagtagattgtatagttt

SEQ ID NO: 1601 - DNA, 23 bp, Homo sapiens
tttcagtcggatgtttgcagctg

SEQ ID NO: 1602 - DNA, 18 bp, Homo sapiens
gtagtaggttgtatagtt

SEQ ID NO: 1603 - DNA, 22 bp, Homo sapiens
caaagtgctgttcgtgcaggta

SEQ ID NO: 1604 - DNA, 23 bp, Homo sapiens
gtcagtttgtcaaataccccaag

SEQ ID NO: 1605 - DNA, 21 bp, Homo sapiens
tgcaccatggttgtctgagca

SEQ ID NO: 1606 - DNA, 22 bp, Homo sapiens
gtatggcactggtagaattcac

SEQ ID NO: 1607 - DNA, 15 bp, Homo sapiens
taccctgtagatccg

SEQ ID NO: 1608 - DNA, 21 bp, Homo sapiens
gtaacagcaactccatgtgga

SEQ ID NO: 1609 - DNA, 24 bp, Homo sapiens
tagcagcgggaacagttctgcagt

SEQ ID NO: 1610 - DNA, 21 bp, Homo sapiens
tgccctgtggactcagttctg

SEQ ID NO: 1611 - DNA, 21 bp, Homo sapiens
tactcaaaaagctgtcagtca

SEQ ID NO: 1612 - DNA, 26 bp, Homo sapiens
tatggcactggtagaattcactgtga

SEQ ID NO: 1613 - DNA, 22 bp, Homo sapiens
cgaatgttgctcggtgaacccc

SEQ ID NO: 1614 - DNA, 20 bp, Homo sapiens
aagacgggaggaaagaaggg

SEQ ID NO: 1615 - DNA, 18 bp, Homo sapiens
ggtagtagtttgtgctgt

SEQ ID NO: 1616 - DNA, 22 bp, Homo sapiens
cttatcagattgtattgtaatt

SEQ ID NO: 1617 - DNA, 22 bp, Homo sapiens
cactggacttggagtcagaaga

SEQ ID NO: 1618 - DNA, 22 bp, Homo sapiens
tcgaggagctcacagtctagta

SEQ ID NO: 1619 - DNA, 22 bp, Homo sapiens
taatctcagctggcaactgtga

SEQ ID NO: 1620 - DNA, 23 bp, Homo sapiens
tttggcaatggtagaactcacac

SEQ ID NO: 1621 - DNA, 20 bp, Homo sapiens
tggacggagaactgataagg

SEQ ID NO: 1622 - DNA, 20 bp, Homo sapiens
atgcacagatctcagacatc

SEQ ID NO: 1623 - DNA, 23 bp, Homo sapiens
tagcagcacataatggtttgtgg

SEQ ID NO: 1624 - DNA, 17 bp, Homo sapiens
cactggtagaattcact

SEQ ID NO: 1625 - DNA, 20 bp, Homo sapiens
tactgcctggtaatgatgac

SEQ ID NO: 1626 - DNA, 21 bp, Homo sapiens
agggcttagctgcttgtgagc

SEQ ID NO: 1627 - DNA, 19 bp, Homo sapiens
cccagtgttcagactacct

SEQ ID NO: 1628 - DNA, 23 bp, Homo sapiens
tctcccaacccttgtaccagtgc

SEQ ID NO: 1629 - DNA, 20 bp, Homo sapiens
agaattgtggctggacatct

SEQ ID NO: 1630 - DNA, 21 bp, Homo sapiens
actgtagtatgggcacttcca

SEQ ID NO: 1631 - DNA, 19 bp, Homo sapiens
tgaggggcagagagcgaga

SEQ ID NO: 1632 - DNA, 19 bp, Homo sapiens
tgtaaacatcctacactct

SEQ ID NO: 1633 - DNA, 22 bp, Homo sapiens
tgagtattacatggccaatctc

SEQ ID NO: 1634 - DNA, 17 bp, Homo sapiens
tttgttcgttcggctcg

SEQ ID NO: 1635 - DNA, 19 bp, Homo sapiens
ttcaccaccttctccaccc

SEQ ID NO: 1636 - DNA, 22 bp, Homo sapiens
tccgagcctgggtctccctctt

SEQ ID NO: 1637 - DNA, 22 bp, Homo sapiens
atcgtacagggtcatccacttt

SEQ ID NO: 1638 - DNA, 21 bp, Homo sapiens
taaacatcctcgactggaagc

SEQ ID NO: 1639 - DNA, 18 bp, Homo sapiens
tgcaacgaacctgagcca

SEQ ID NO: 1640 - DNA, 18 bp, Homo sapiens
cttatcagactgatgttg

SEQ ID NO: 1641 - DNA, 21 bp, Homo sapiens
cagatcagaaggtgattgtgg

SEQ ID NO: 1642 - DNA, 18 bp, Homo sapiens
tgtagtgtttcctacttt

SEQ ID NO: 1643 - DNA, 21 bp, Homo sapiens
tccggttctcagggctccacc

SEQ ID NO: 1644 - DNA, 19 bp, Homo sapiens
cggaatcccaaaagcagct

SEQ ID NO: 1645 - DNA, 17 bp, Homo sapiens
caatggtagaactcaca

SEQ ID NO: 1646 - DNA, 19 bp, Homo sapiens
tattgcacttgtcccggcc

SEQ ID NO: 1647 - DNA, 18 bp, Homo sapiens
tgaggtagtagtttgtac

SEQ ID NO: 1648 - DNA, 15 bp, Homo sapiens
cacccgtagaaccga

SEQ ID NO: 1649 - DNA, 16 bp, Homo sapiens
ctttcagtcggatgtt

SEQ ID NO: 1650 - DNA, 25 bp, Homo sapiens
cgaatgttgctcggtgaaccccttt

SEQ ID NO: 1651 - DNA, 21 bp, Homo sapiens
actggttgaacaactgaaccc

SEQ ID NO: 1652 - DNA, 21 bp, Homo sapiens
tggaatgtaaggaagtgtgtg

SEQ ID NO: 1653 - DNA, 22 bp, Homo sapiens
aacccgtagatccgaacttgtg

SEQ ID NO: 1654 - DNA, 23 bp, Homo sapiens
agcttctttacagtgctgccttg

SEQ ID NO: 1655 - DNA, 23 bp, Homo sapiens
cagatcagaaggtgattgtggct

SEQ ID NO: 1656 - DNA, 22 bp, Homo sapiens
tgtttgcagaggaaactgagac

SEQ ID NO: 1657 - DNA, 22 bp, Homo sapiens
tgctgattcctgggctctgacc

SEQ ID NO: 1658 - DNA, 22 bp, Homo sapiens
tgatatgtttgatattgggttg

SEQ ID NO: 1659 - DNA, 23 bp, Homo sapiens
tgtctgcccgcatgcctgcctct

SEQ ID NO: 1660 - DNA, 19 bp, Homo sapiens
caaagtgctgttcgtgcag

SEQ ID NO: 1661 - DNA, 24 bp, Homo sapiens
tagcagcacataatggtttgtgga

SEQ ID NO: 1662 - DNA, 19 bp, Homo sapiens
gaggtagtaggttgtgtgg

SEQ ID NO: 1663 - DNA, 25 bp, Homo sapiens
tatggcactggtagaattcactgtg

SEQ ID NO: 1664 - DNA, 21 bp, Homo sapiens
tgagaaccacgtctgctctga

SEQ ID NO: 1665 - DNA, 24 bp, Homo sapiens
caaagtgctgttcgtgcaggtagt

SEQ ID NO: 1666 - DNA, 20 bp, Homo sapiens
ttgaggtagtaggttgtatg

SEQ ID NO: 1667 - DNA, 18 bp, Homo sapiens
tgcactacagaactttgt

SEQ ID NO: 1668 - DNA, 20 bp, Homo sapiens
caggtcacgtctctgcagtt

SEQ ID NO: 1669 - DNA, 22 bp, Homo sapiens
ccaatattggctgtgctgctcc

SEQ ID NO: 1670 - DNA, 21 bp, Homo sapiens
ctacagtatagatgatgtact

SEQ ID NO: 1671 - DNA, 21 bp, Homo sapiens
ctctagccacagatgcagtga

SEQ ID NO: 1672 - DNA, 21 bp, Homo sapiens
ttacagttgttcaaccagtta

SEQ ID NO: 1673 - DNA, 23 bp, Homo sapiens
ttctcgaggaaagaagcactttc

SEQ ID NO: 1674 - DNA, 22 bp, Homo sapiens
tcacacagaaatcgcacccgtc

SEQ ID NO: 1675 - DNA, 21 bp, Homo sapiens
tctcacacagaaatcgcaccc

SEQ ID NO: 1676 - DNA, 22 bp, Homo sapiens
tacagcaggcacagacaggcag

SEQ ID NO: 1677 - DNA, 21 bp, Homo sapiens
tactccagagggcgtcactca

SEQ ID NO: 1678 - DNA, 22 bp, Homo sapiens
tactcaaaaagctgtcagtcac

SEQ ID NO: 1679 - DNA, 21 bp, Homo sapiens
gtcaacacttgctggtttcct

SEQ ID NO: 1680 - DNA, 21 bp, Homo sapiens
tggcagtgtattgttagctgg

SEQ ID NO: 1681 - DNA, 23 bp, Homo sapiens
aacattcattgctgtcggtgggt

SEQ ID NO: 1682 - DNA, 23 bp, Homo sapiens
gtgtcttttgctctgcagtcagt

SEQ ID NO: 1683 - DNA, 24 bp, Homo sapiens
taccacagggtagaaccacggaca

SEQ ID NO: 1684 - DNA, 20 bp, Homo sapiens
atgatctgttttgctgttgt

SEQ ID NO: 1685 - DNA, 21 bp, Homo sapiens
tgaagctcagagggctctgat

SEQ ID NO: 1686 - DNA, 21 bp, Homo sapiens
agtattacatggccaatctcc

SEQ ID NO: 1687 - DNA, 19 bp, Homo sapiens
aacattcattgctgtcggt

SEQ ID NO: 1688 - DNA, 18 bp, Homo sapiens
tggtagactatggaacgt

SEQ ID NO: 1689 - DNA, 17 bp, Homo sapiens
tattgcacttgtcccgg

SEQ ID NO: 1690 - DNA, 23 bp, Homo sapiens
tagcaccatttgaaatcagtgtt

SEQ ID NO: 1691 - DNA, 20 bp, Homo sapiens
tcaggctcagtcccctcccg

SEQ ID NO: 1692 - DNA, 20 bp, Homo sapiens
ttgtgcttgatctaaccatg

SEQ ID NO: 1693 - DNA, 19 bp, Homo sapiens
tactgccgggtaatgatgg

SEQ ID NO: 1694 - DNA, 19 bp, Homo sapiens
ggtagtagattgtatagtt

SEQ ID NO: 1695 - DNA, 26 bp, Homo sapiens
cctcctgatgattcttcttcctgagc

SEQ ID NO: 1696 - DNA, 22 bp, Homo sapiens
aatcatacagggacatccagtt

SEQ ID NO: 1697 - DNA, 18 bp, Homo sapiens
aaaccgttaccattactg

SEQ ID NO: 1698 - DNA, 17 bp, Homo sapiens
ctgagatgaagcactgt

SEQ ID NO: 1699 - DNA, 21 bp, Homo sapiens
taaggtgcatctagtgcagat

SEQ ID NO: 1700 - DNA, 20 bp, Homo sapiens
tcttggagtaggtcattggg

SEQ ID NO: 1701 - DNA, 20 bp, Homo sapiens
cactgtctggtaaagatggc

SEQ ID NO: 1702 - DNA, 21 bp, Homo sapiens
tgagtgtactgtgggcttcgg

SEQ ID NO: 1703 - DNA, 22 bp, Homo sapiens
ccacttggatctgaaggctgcc

SEQ ID NO: 1704 - DNA, 23 bp, Homo sapiens
tatgtgcctttggactacatcgt

SEQ ID NO: 1705 - DNA, 18 bp, Homo sapiens
acagtagtctgcacattg

SEQ ID NO: 1706 - DNA, 16 bp, Homo sapiens
tgaggtagtagattgt

SEQ ID NO: 1707 - DNA, 25 bp, Homo sapiens
tggaagactagtgattttgttgttg

SEQ ID NO: 1708 - DNA, 22 bp, Homo sapiens
ttttgcaatatgttcctgaata

SEQ ID NO: 1709 - DNA, 22 bp, Homo sapiens
gtacagtactgtgataactgaa

SEQ ID NO: 1710 - DNA, 21 bp, Homo sapiens
tttcctatgcatatacttctt

SEQ ID NO: 1711 - DNA, 18 bp, Homo sapiens
gactatagaactttcccc

SEQ ID NO: 1712 - DNA, 21 bp, Homo sapiens
tgcagtccatgggcatataca

SEQ ID NO: 1713 - DNA, 23 bp, Homo sapiens
acttaaacgtggatgtacttgct

SEQ ID NO: 1714 - DNA, 20 bp, Homo sapiens
tcagtgcatcacagaacttt

SEQ ID NO: 1715 - DNA, 20 bp, Homo sapiens
tgattgacacttctgtgagt

SEQ ID NO: 1716 - DNA, 20 bp, Homo sapiens
cagtgcatgacagaacttgg

SEQ ID NO: 1717 - DNA, 23 bp, Homo sapiens
tatggcactggtagaattcactg

SEQ ID NO: 1718 - DNA, 20 bp, Homo sapiens
tgagaaccacgtctgctctg

SEQ ID NO: 1719 - DNA, 21 bp, Homo sapiens
caagtcaggtactcgaatgga

SEQ ID NO: 1720 - DNA, 21 bp, Homo sapiens
gtcgattggacccgccctccg

SEQ ID NO: 1721 - DNA, 19 bp, Homo sapiens
ttccctttgtcatcctatg

SEQ ID NO: 1722 - DNA, 20 bp, Homo sapiens
cgaatgttgctcggtgaacc

SEQ ID NO: 1723 - DNA, 20 bp, Homo sapiens
ctcctatatgatgcctttct

SEQ ID NO: 1724 - DNA, 21 bp, Homo sapiens
gtaaacatccccgactggaag

SEQ ID NO: 1725 - DNA, 22 bp, Homo sapiens
ggggtgctatctgtgattgagg

SEQ ID NO: 1726 - DNA, 21 bp, Homo sapiens
caacggaatcccaaaagcagc

SEQ ID NO: 1727 - DNA, 22 bp, Homo sapiens
cagtggggctgctgttatctgg

SEQ ID NO: 1728 - DNA, 20 bp, Homo sapiens
cattgcacttgtctcggtct

SEQ ID NO: 1729 - DNA, 21 bp, Homo sapiens
aggcagtgtagttagctgatt

SEQ ID NO: 1730 - DNA, 20 bp, Homo sapiens
tatggcttttcattcctatg

SEQ ID NO: 1731 - DNA, 15 bp, Homo sapiens
caacaccagtcgatg

SEQ ID NO: 1732 - DNA, 19 bp, Homo sapiens
ctttcagtcggatgtttac

SEQ ID NO: 1733 - DNA, 17 bp, Homo sapiens
aacccgtagatccgaac

SEQ ID NO: 1734 - DNA, 22 bp, Homo sapiens
acttaaacgtggatgtacttgc

SEQ ID NO: 1735 - DNA, 22 bp, Homo sapiens
taaacatcctcgactggaagct

SEQ ID NO: 1736 - DNA, 20 bp, Homo sapiens
gagatgaagcactgtagctc

SEQ ID NO: 1737 - DNA, 18 bp, Homo sapiens
gcagtccatgggcatata

SEQ ID NO: 1738 - DNA, 23 bp, Homo sapiens
taagtgcttccatgtttcagtgg

SEQ ID NO: 1739 - DNA, 18 bp, Homo sapiens
tctcccaacccttgtacc

SEQ ID NO: 1740 - DNA, 21 bp, Homo sapiens
tgtaaacatcctcgactggaa

SEQ ID NO: 1741 - DNA, 19 bp, Homo sapiens
tagcaccatctgaaatcgg

SEQ ID NO: 1742 - DNA, 22 bp, Homo sapiens
ttggttatctagctgtatgagt

SEQ ID NO: 1743 - DNA, 22 bp, Homo sapiens
ggggttcctggggatgggattt

SEQ ID NO: 1744 - DNA, 19 bp, Homo sapiens
tgaggtagtaggttgtata

SEQ ID NO: 1745 - DNA, 23 bp, Homo sapiens
tccctgagaccctaacttgtgag

SEQ ID NO: 1746 - DNA, 24 bp, Homo sapiens
ttccctttgtcatcctatgcctga

SEQ ID NO: 1747 - DNA, 21 bp, Homo sapiens
ttaaggcacgcggtgaatgcc

SEQ ID NO: 1748 - DNA, 19 bp, Homo sapiens
ccctgtagaaccgaatttg

SEQ ID NO: 1749 - DNA, 23 bp, Homo sapiens
atagcccggtcgctggtacatga

SEQ ID NO: 1750 - DNA, 20 bp, Homo sapiens
atcttaccggacagtgctgg

SEQ ID NO: 1751 - DNA, 22 bp, Homo sapiens
gctcagttcagcaggaacagga

SEQ ID NO: 1752 - DNA, 17 bp, Homo sapiens
atggtagaactcacact

SEQ ID NO: 1753 - DNA, 22 bp, Homo sapiens
cctcagggctgtagaacagggc

SEQ ID NO: 1754 - DNA, 20 bp, Homo sapiens
cccgtagaaccgaccttgcg

SEQ ID NO: 1755 - DNA, 22 bp, Homo sapiens
ccacccgtagaaccgaccttgc

SEQ ID NO: 1756 - DNA, 21 bp, Homo sapiens
acaggtgaggttcttgggagc

SEQ ID NO: 1757 - DNA, 17 bp, Homo sapiens
tattgcactcgtcccgg

SEQ ID NO: 1758 - DNA, 19 bp, Homo sapiens
tgaggtagtagtttgtgct

SEQ ID NO: 1759 - DNA, 22 bp, Homo sapiens
tctgtcatttctttaggccaat

SEQ ID NO: 1760 - DNA, 23 bp, Homo sapiens
ctagcaccatctgaaatcggtta

SEQ ID NO: 1761 - DNA, 18 bp, Homo sapiens
ctgtgggaactggaggta

SEQ ID NO: 1762 - DNA, 20 bp, Homo sapiens
agaggtatagggcatgggaa

SEQ ID NO: 1763 - DNA, 21 bp, Homo sapiens
accctgtagaaccgaatttgt

SEQ ID NO: 1764 - DNA, 19 bp, Homo sapiens
ctcagttcagcaggaacag

SEQ ID NO: 1765 - DNA, 21 bp, Homo sapiens
accctgtagatccgaatttgt

SEQ ID NO: 1766 - DNA, 17 bp, Homo sapiens
atgtttaggaccactag

SEQ ID NO: 1767 - DNA, 19 bp, Homo sapiens
gtgaaatgtttaggaccac

SEQ ID NO: 1768 - DNA, 19 bp, Homo sapiens
gtgcattgctgttgcattg

SEQ ID NO: 1769 - DNA, 21 bp, Homo sapiens
tgtgaaatgtttaggaccact

SEQ ID NO: 1770 - DNA, 20 bp, Homo sapiens
aactggccctcaaagtcccg

SEQ ID NO: 1771 - DNA, 20 bp, Homo sapiens
ttcacagtggctaagttctg

SEQ ID NO: 1772 - DNA, 23 bp, Homo sapiens
caatcactaactccactgccatc

SEQ ID NO: 1773 - DNA, 21 bp, Homo sapiens
tggaagactagtgattttgtt

SEQ ID NO: 1774 - DNA, 16 bp, Homo sapiens
atcacattgccaggga

SEQ ID NO: 1775 - DNA, 22 bp, Homo sapiens
tagcaccatttgaaatcggtta

SEQ ID NO: 1776 - DNA, 19 bp, Homo sapiens
atccccagatacaatggac

SEQ ID NO: 1777 - DNA, 21 bp, Homo sapiens
cggggttttgagggcgagatg

SEQ ID NO: 1778 - DNA, 21 bp, Homo sapiens
tgtaaacatcctacactcagc

SEQ ID NO: 1779 - DNA, 21 bp, Homo sapiens
tttaacatgggggtacctgct

SEQ ID NO: 1780 - DNA, 20 bp, Homo sapiens
gaggtagtaggttgtatagt

SEQ ID NO: 1781 - DNA, 21 bp, Homo sapiens
aaggcagggcccccgctcccc

SEQ ID NO: 1782 - DNA, 18 bp, Homo sapiens
gcacttgtcccggcctgt

SEQ ID NO: 1783 - DNA, 21 bp, Homo sapiens
acagattcgattctaggggaa

SEQ ID NO: 1784 - DNA, 19 bp, Homo sapiens
tgagatgaagcactgtagc

SEQ ID NO: 1785 - DNA, 22 bp, Homo sapiens
gctacatctggctactgggtct

SEQ ID NO: 1786 - DNA, 20 bp, Homo sapiens
cggatccgtctgagcttggc

SEQ ID NO: 1787 - DNA, 23 bp, Homo sapiens
aacggaatcccaaaagcagctgt

SEQ ID NO: 1788 - DNA, 23 bp, Homo sapiens
ctttggttatctagctgtatgag

SEQ ID NO: 1789 - DNA, 23 bp, Homo sapiens
aggcagtgtcattagctgattgt

SEQ ID NO: 1790 - DNA, 18 bp, Homo sapiens
cagtagtctgcacattgg

SEQ ID NO: 1791 - DNA, 20 bp, Homo sapiens
ttctcaaggaggtgtcgttt

SEQ ID NO: 1792 - DNA, 18 bp, Homo sapiens
aacccgtagatccgatct

SEQ ID NO: 1793 - DNA, 24 bp, Homo sapiens
tgcaacgaacctgagccactgatt

SEQ ID NO: 1794 - DNA, 21 bp, Homo sapiens
tgcctgtctacacttgctgtg

SEQ ID NO: 1795 - DNA, 21 bp, Homo sapiens
caaagtgctcatagtgcaggt

SEQ ID NO: 1796 - DNA, 21 bp, Homo sapiens
gctgccagttgaagaactgtt

SEQ ID NO: 1797 - DNA, 22 bp, Homo sapiens
cacgctcatgcacacacccaca

SEQ ID NO: 1798 - DNA, 23 bp, Homo sapiens
ctcggcgtggcgtcggtcgtggt

SEQ ID NO: 1799 - DNA, 22 bp, Homo sapiens
aatcactaactccactgccatc

SEQ ID NO: 1800 - DNA, 19 bp, Homo sapiens
tccctgagaccctttaacc

SEQ ID NO: 1801 - DNA, 21 bp, Homo sapiens
catcatcgtctcaaatgagtc

SEQ ID NO: 1802 - DNA, 18 bp, Homo sapiens
ttccctttgtcatccttc

SEQ ID NO: 1803 - DNA, 22 bp, Homo sapiens
taaagtgctgacagtgcagata

SEQ ID NO: 1804 - DNA, 22 bp, Homo sapiens
tctcccaacccttgtaccagtg

SEQ ID NO: 1805 - DNA, 19 bp, Homo sapiens
gtagtgtttcctactttat

SEQ ID NO: 1806 - DNA, 21 bp, Homo sapiens
atcactaaccacacggccagg

SEQ ID NO: 1807 - DNA, 21 bp, Homo sapiens
agctggtgttgtgaatcaggc

SEQ ID NO: 1808 - DNA, 24 bp, Homo sapiens
tgtaacagcaactccatgtggact

SEQ ID NO: 1809 - DNA, 19 bp, Homo sapiens
ggtagtagtttgtacagtt

SEQ ID NO: 1810 - DNA, 21 bp, Homo sapiens
gtagcttatcagactgatgtt

SEQ ID NO: 1811 - DNA, 22 bp, Homo sapiens
tatgtgggatggtaaaccgctt

SEQ ID NO: 1812 - DNA, 21 bp, Homo sapiens
ctcctgccctccttgctgtag

SEQ ID NO: 1813 - DNA, 22 bp, Homo sapiens
agaggtatagggcatgggaaaa

SEQ ID NO: 1814 - DNA, 23 bp, Homo sapiens
tccagcatcagtgattttgttga

SEQ ID NO: 1815 - DNA, 22 bp, Homo sapiens
actctagctgccaaaggcgctt

SEQ ID NO: 1816 - DNA, 19 bp, Homo sapiens
cagcacgtaaatattggcg

SEQ ID NO: 1817 - DNA, 18 bp, Homo sapiens
ctgtgcgtgtgacagcgg

SEQ ID NO: 1818 - DNA, 23 bp, Homo sapiens
cggggccgtagcactgtctgaga

SEQ ID NO: 1819 - DNA, 25 bp, Homo sapiens
cagtgcaatagtattgtcaaagcat

SEQ ID NO: 1820 - DNA, 18 bp, Homo sapiens
gcattgtacagggctatg

SEQ ID NO: 1821 - DNA, 20 bp, Homo sapiens
gacacgatcactcccgttga

SEQ ID NO: 1822 - DNA, 22 bp, Homo sapiens
taagtgcttccatgtttcagtg

SEQ ID NO: 1823 - DNA, 21 bp, Homo sapiens
actgccctaagtgctccttct

SEQ ID NO: 1824 - DNA, 19 bp, Homo sapiens
tacagtagtctgcacattg

SEQ ID NO: 1825 - DNA, 23 bp, Homo sapiens
actggacttggagtcagaaggcc

SEQ ID NO: 1826 - DNA, 22 bp, Homo sapiens
tgcaacttacctgagtcattga

SEQ ID NO: 1827 - DNA, 19 bp, Homo sapiens
cacattgccagggatttcc

SEQ ID NO: 1828 - DNA, 22 bp, Homo sapiens
ttctcaagagggaggcaatcat

SEQ ID NO: 1829 - DNA, 20 bp, Homo sapiens
tatgccaacatattgccatc

SEQ ID NO: 1830 - DNA, 19 bp, Homo sapiens
tcccccaggtgtgattctg

SEQ ID NO: 1831 - DNA, 22 bp, Homo sapiens
cagatcagaaggtgattgtggc

SEQ ID NO: 1832 - DNA, 19 bp, Homo sapiens
ggtagtagtttgtgctgtt

SEQ ID NO: 1833 - DNA, 22 bp, Homo sapiens
cgggaacgtcgagactggagcg

SEQ ID NO: 1834 - DNA, 22 bp, Homo sapiens
ctgaggtagtagtttgtacagt

SEQ ID NO: 1835 - DNA, 21 bp, Homo sapiens
tgtctactactggagacactg

SEQ ID NO: 1836 - DNA, 20 bp, Homo sapiens
tatgtgcctttggactacat

SEQ ID NO: 1837 - DNA, 19 bp, Homo sapiens
gtgaggactcgggaggtgg

SEQ ID NO: 1838 - DNA, 22 bp, Homo sapiens
gctatgccaacatattgccatc

SEQ ID NO: 1839 - DNA, 18 bp, Homo sapiens
ctggactgagccgtgcta

SEQ ID NO: 1840 - DNA, 24 bp, Homo sapiens
ttcaagtaatccaggataggctgt

SEQ ID NO: 1841 - DNA, 19 bp, Homo sapiens
gaagtgcttcgattttggg

SEQ ID NO: 1842 - DNA, 22 bp, Homo sapiens
tagataaaatattggtacctga

SEQ ID NO: 1843 - DNA, 22 bp, Homo sapiens
aaatctctgcaggcaaatgtga

SEQ ID NO: 1844 - DNA, 25 bp, Homo sapiens
ataccctgtagatccgaatttgtgt

SEQ ID NO: 1845 - DNA, 22 bp, Homo sapiens
atctttggttatctagctgtat

SEQ ID NO: 1846 - DNA, 18 bp, Homo sapiens
caatggtagaactcacac

SEQ ID NO: 1847 - DNA, 20 bp, Homo sapiens
tttggcaatggtagaactca

SEQ ID NO: 1848 - DNA, 18 bp, Homo sapiens
gttttcccaggaatccct

SEQ ID NO: 1849 - DNA, 22 bp, Homo sapiens
atgtagggatggaagccatgaa

SEQ ID NO: 1850 - DNA, 22 bp, Homo sapiens
aaagtgcatccttttagagtgt

SEQ ID NO: 1851 - DNA, 22 bp, Homo sapiens
cactggctcctttctgggtaga

SEQ ID NO: 1852 - DNA, 22 bp, Homo sapiens
aaatggtgccctagtgactaca

SEQ ID NO: 1853 - DNA, 23 bp, Homo sapiens
caaagtgcctccctttagagtgt

SEQ ID NO: 1854 - DNA, 22 bp, Homo sapiens
aacattcattgctgtcggtggg

SEQ ID NO: 1855 - DNA, 20 bp, Homo sapiens
tctcacacagaaatcgcacc

SEQ ID NO: 1856 - DNA, 20 bp, Homo sapiens
ttggcaatggtagaactcac

SEQ ID NO: 1857 - DNA, 23 bp, Homo sapiens
agtcatacacggctctcctctct

SEQ ID NO: 1858 - DNA, 19 bp, Homo sapiens
gtaaacatcctcgactgga

SEQ ID NO: 1859 - DNA, 28 bp, Homo sapiens
tatggcactggtagaattcactgtgaac

SEQ ID NO: 1860 - DNA, 20 bp, Homo sapiens
taatactgtctggtaaaacc

SEQ ID NO: 1861 - DNA, 20 bp, Homo sapiens
cactgtctggtaacgatgtt

SEQ ID NO: 1862 - DNA, 19 bp, Homo sapiens
acagtactgtgataactga

SEQ ID NO: 1863 - DNA, 24 bp, Homo sapiens
agcagcattgtacagggctatgaa

SEQ ID NO: 1864 - DNA, 20 bp, Homo sapiens
cccgtagatccgaacttgtg

SEQ ID NO: 1865 - DNA, 18 bp, Homo sapiens
aacatcctcgactggaag

SEQ ID NO: 1866 - DNA, 18 bp, Homo sapiens
gtgcactacagaactttg

SEQ ID NO: 1867 - DNA, 21 bp, Homo sapiens
aatactgcctggtaatgatga

SEQ ID NO: 1868 - DNA, 20 bp, Homo sapiens
tccctgtcctccaggagctc

SEQ ID NO: 1869 - DNA, 21 bp, Homo sapiens
tccccgactggaagctgtaag

SEQ ID NO: 1870 - DNA, 24 bp, Homo sapiens
agctggtgttgtgaatcaggccgt

SEQ ID NO: 1871 - DNA, 20 bp, Homo sapiens
atactgccgggtaatgatgg

SEQ ID NO: 1872 - DNA, 21 bp, Homo sapiens
ctccagagggatgcactttct

SEQ ID NO: 1873 - DNA, 18 bp, Homo sapiens
cagtactgtgataactga

SEQ ID NO: 1874 - DNA, 21 bp, Homo sapiens
accacagggtagaaccacgga

SEQ ID NO: 1875 - DNA, 22 bp, Homo sapiens
tgcctgctggggtggaacctgg

SEQ ID NO: 1876 - DNA, 23 bp, Homo sapiens
ctgtcctaaggttgttgagttgt

SEQ ID NO: 1877 - DNA, 18 bp, Homo sapiens
acatcctcgactggaagc

SEQ ID NO: 1878 - DNA, 19 bp, Homo sapiens
tcacagtggctaagttccg

SEQ ID NO: 1879 - DNA, 21 bp, Homo sapiens
gtatggcactggtagaattca

SEQ ID NO: 1880 - DNA, 20 bp, Homo sapiens
cgaatcattatttgctgctc

SEQ ID NO: 1881 - DNA, 23 bp, Homo sapiens
agaggctggccgtgatgaattcg

SEQ ID NO: 1882 - DNA, 20 bp, Homo sapiens
gtgtcttttgctctgcagtc

SEQ ID NO: 1883 - DNA, 20 bp, Homo sapiens
tagactgaagctccttgagg

SEQ ID NO: 1884 - DNA, 22 bp, Homo sapiens
atcatacaaggacaatttcttt

SEQ ID NO: 1885 - DNA, 23 bp, Homo sapiens
gaagtgcttcgattttggggtgt

SEQ ID NO: 1886 - DNA, 22 bp, Homo sapiens
caggtcacgtctctgcagttac

SEQ ID NO: 1887 - DNA, 24 bp, Homo sapiens
tgaggtagtaggttgtatagttta

SEQ ID NO: 1888 - DNA, 23 bp, Homo sapiens
ataaagctagataaccgaaagta

SEQ ID NO: 1889 - DNA, 22 bp, Homo sapiens
aagtgctgcgacatttgagcgt

SEQ ID NO: 1890 - DNA, 21 bp, Homo sapiens
tggttgaccagagagcacacg

SEQ ID NO: 1891 - DNA, 23 bp, Homo sapiens
tcaagtaatccaggataggctgt

SEQ ID NO: 1892 - DNA, 21 bp, Homo sapiens
taaacgtggatgtacttgctt

SEQ ID NO: 1893 - DNA, 21 bp, Homo sapiens
tggtttaccgtcccacataca

SEQ ID NO: 1894 - DNA, 24 bp, Homo sapiens
tactccagagggcgtcactcatgt

SEQ ID NO: 1895 - DNA, 22 bp, Homo sapiens
agaggttgcccttggtgaattc

SEQ ID NO: 1896 - DNA, 22 bp, Homo sapiens
cctcaaatgtggagcactattc

SEQ ID NO: 1897 - DNA, 21 bp, Homo sapiens
gaagtgcttcgattttggggt

SEQ ID NO: 1898 - DNA, 22 bp, Homo sapiens
agtgccgccatcttttgagtgt

SEQ ID NO: 1899 - DNA, 20 bp, Homo sapiens
actcaaactgtgggggcact

SEQ ID NO: 1900 - DNA, 23 bp, Homo sapiens
ttaatgctaatcgtgataggggt

SEQ ID NO: 1901 - DNA, 21 bp, Homo sapiens
aaagtgctgcgacatttgagc

SEQ ID NO: 1902 - DNA, 23 bp, Homo sapiens
tgcaggtcgtcttgcagggcttc

SEQ ID NO: 1903 - DNA, 23 bp, Homo sapiens
tgtaaggcacccttctgagtaga

SEQ ID NO: 1904 - DNA, 23 bp, Homo sapiens
gagaactgaattccatgggttgt

SEQ ID NO: 1905 - DNA, 22 bp, Homo sapiens
taacagtctacagccatggtcg

SEQ ID NO: 1906 - DNA, 21 bp, Homo sapiens
atcatagaggaaaatccacgt

SEQ ID NO: 1907 - DNA, 21 bp, Homo sapiens
caggtcacgtctctgcagtta

SEQ ID NO: 1908 - DNA, 22 bp, Homo sapiens
aaagtgcttccctttggactgt

SEQ ID NO: 1909 - DNA, 22 bp, Homo sapiens
tcacaagtcaggctcttgggac

SEQ ID NO: 1910 - DNA, 19 bp, Homo sapiens
tagcttatcagactgatgt

SEQ ID NO: 1911 - DNA, 20 bp, Homo sapiens
tctacagtgcacgtgtctcc

SEQ ID NO: 1912 - DNA, 20 bp, Homo sapiens
tgaagctcagagggctctga

SEQ ID NO: 1913 - DNA, 24 bp, Homo sapiens
cgaatgttgctcggtgaacccctt

SEQ ID NO: 1914 - DNA, 21 bp, Homo sapiens
ctggtacaggcctgggggaca

SEQ ID NO: 1915 - DNA, 24 bp, Homo sapiens
tgcaggtcgtcttgcagggcttct

SEQ ID NO: 1916 - DNA, 21 bp, Homo sapiens
tatgtaacacggtccactaac

SEQ ID NO: 1917 - DNA, 22 bp, Homo sapiens
ctctagagggaagcactttctc

SEQ ID NO: 1918 - DNA, 22 bp, Homo sapiens
atcatgatgggctcctcggtgt

SEQ ID NO: 1919 - DNA, 21 bp, Homo sapiens
ctccagagggaagtactttct

SEQ ID NO: 1920 - DNA, 21 bp, Homo sapiens
tcttggagtaggtcattgggt

SEQ ID NO: 1921 - DNA, 20 bp, Homo sapiens
tagcgtgtggtacttgaaga

SEQ ID NO: 1922 - DNA, 22 bp, Homo sapiens
atcatagaggaaaatccatgtt

SEQ ID NO: 1923 - DNA, 21 bp, Homo sapiens
catgccttgagtgtaggaccg

SEQ ID NO: 1924 - DNA, 21 bp, Homo sapiens
gacctctgaaattcagttctt

SEQ ID NO: 1925 - DNA, 20 bp, Homo sapiens
aagtgctgtcatagctgagg

SEQ ID NO: 1926 - DNA, 18 bp, Homo sapiens
ggttatctagctgtatga

SEQ ID NO: 1927 - DNA, 22 bp, Homo sapiens
caggtcgtcttgcagggcttct

SEQ ID NO: 1928 - DNA, 24 bp, Homo sapiens
aagctgccagttgaagaactgttg

SEQ ID NO: 1929 - DNA, 24 bp, Homo sapiens
ttgtgcttgatctaaccatgtggt

SEQ ID NO: 1930 - DNA, 22 bp, Homo sapiens
agttgttcgtggtggattcgct

SEQ ID NO: 1931 - DNA, 22 bp, Homo sapiens
tcggatccgtctgagcttggct

SEQ ID NO: 1932 - DNA, 21 bp, Homo sapiens
aagaggtatagggcatgggaa

SEQ ID NO: 1933 - DNA, 22 bp, Homo sapiens
aagtgcttccatgttttggtga

SEQ ID NO: 1934 - DNA, 22 bp, Homo sapiens
tgggtttacgttgggagaactt

SEQ ID NO: 1935 - DNA, 22 bp, Homo sapiens
gtggttatccctgctgtgttcg

SEQ ID NO: 1936 - DNA, 21 bp, Homo sapiens
tactgtaaacgctttctgatg

SEQ ID NO: 1937 - DNA, 21 bp, Homo sapiens
ttgcatagtcacaaaagtgat

SEQ ID NO: 1938 - DNA, 23 bp, Homo sapiens
tatgtctgctgaccatcaccttt

SEQ ID NO: 1939 - DNA, 21 bp, Homo sapiens
gtaaggcacccttctgagtag

SEQ ID NO: 1940 - DNA, 23 bp, Homo sapiens
actgatttcttttggtgttcaga

SEQ ID NO: 1941 - DNA, 19 bp, Homo sapiens
tgattgtagccttttggag

SEQ ID NO: 1942 - DNA, 20 bp, Homo sapiens
aataatacatggttgatctt

SEQ ID NO: 1943 - DNA, 22 bp, Homo sapiens
tactccagagggcgtcactcat

SEQ ID NO: 1944 - DNA, 25 bp, Homo sapiens
ttgcaggtcgtcttgcagggcttct

SEQ ID NO: 1945 - DNA, 22 bp, Homo sapiens
aacatagaggaaattccacgtt

SEQ ID NO: 1946 - DNA, 22 bp, Homo sapiens
gtcaacacttgctggtttcctc

SEQ ID NO: 1947 - DNA, 21 bp, Homo sapiens
tattgcacttgtcccggcctg

SEQ ID NO: 1948 - DNA, 22 bp, Homo sapiens
aaacattcgcggtgcacttctt

SEQ ID NO: 1949 - DNA, 23 bp, Homo sapiens
ttgcaggtcgtcttgcagggctt

SEQ ID NO: 1950 - DNA, 21 bp, Homo sapiens
actcaaaatgggggcgctttc

SEQ ID NO: 1951 - DNA, 21 bp, Homo sapiens
aagcccttaccccaaaaagca

SEQ ID NO: 1952 - DNA, 22 bp, Homo sapiens
tggtgggccgcagaacatgtgc

SEQ ID NO: 1953 - DNA, 22 bp, Homo sapiens
atgtagggctaaaagccatggg

SEQ ID NO: 1954 - DNA, 22 bp, Homo sapiens
atggtagactatggaacgtagg

SEQ ID NO: 1955 - DNA, 21 bp, Homo sapiens
aatgttgctcggtgaacccct

SEQ ID NO: 1956 - DNA, 22 bp, Homo sapiens
ttcacagtggctaagttctgca

SEQ ID NO: 1957 - DNA, 23 bp, Homo sapiens
tggcagtgtcttagctggttgtt

SEQ ID NO: 1958 - DNA, 20 bp, Homo sapiens
tgaggtagtaggttgtatgg

SEQ ID NO: 1959 - DNA, 23 bp, Homo sapiens
tacgtcatcgttgtcatcgtcat

SEQ ID NO: 1960 - DNA, 22 bp, Homo sapiens
atggttgaccatagaacatgcg

SEQ ID NO: 1961 - DNA, 23 bp, Homo sapiens
caagctcgcttctatgggtctgt

SEQ ID NO: 1962 - DNA, 22 bp, Homo sapiens
gtcagtgcatgacagaacttgg

SEQ ID NO: 1963 - DNA, 22 bp, Homo sapiens
agtcccccaggtgtgattctga

SEQ ID NO: 1964 - DNA, 21 bp, Homo sapiens
ggagaaattatccttggtgtg

SEQ ID NO: 1965 - DNA, 22 bp, Homo sapiens
atcgtgcatccctttagagtgt

SEQ ID NO: 1966 - DNA, 20 bp, Homo sapiens
ctagactgaagctccttgag

SEQ ID NO: 1967 - DNA, 25 bp, Homo sapiens
aagacgggaggaaagaagggagtgg

SEQ ID NO: 1968 - DNA, 22 bp, Homo sapiens
aggttacccgagcaactttgca

SEQ ID NO: 1969 - DNA, 24 bp, Homo sapiens
ctcggcgtggcgtcggtcgtggta

SEQ ID NO: 1970 - DNA, 22 bp, Homo sapiens
gaagctcagagggctctgattc

SEQ ID NO: 1971 - DNA, 19 bp, Homo sapiens
agtgtttcctactttatgg

SEQ ID NO: 1972 - DNA, 23 bp, Homo sapiens
aaggagctcacagtctattgagt

SEQ ID NO: 1973 - DNA, 21 bp, Homo sapiens
ttgattgacacttctgtgagt

SEQ ID NO: 1974 - DNA, 25 bp, Homo sapiens
tcccccaggtgtgattctgatttgc

SEQ ID NO: 1975 - DNA, 24 bp, Homo sapiens
tcaaatgctcagactcctgtggtg

SEQ ID NO: 1976 - DNA, 23 bp, Homo sapiens
caggtcacgtctctgcagttaca

SEQ ID NO: 1977 - DNA, 22 bp, Homo sapiens
aaactgtaattacttttggacc

SEQ ID NO: 1978 - DNA, 22 bp, Homo sapiens
tgtcagtttgtcaaatacccca

SEQ ID NO: 1979 - DNA, 19 bp, Homo sapiens
ttcaagtaatccaggatag

SEQ ID NO: 1980 - DNA, 24 bp, Homo sapiens
tgtctcccaacccttgtaccagtg

SEQ ID NO: 1981 - DNA, 22 bp, Homo sapiens
tgaagctcagagggctctgatt

SEQ ID NO: 1982 - DNA, 22 bp, Homo sapiens
tgcaggtcgtcttgcagggctt

SEQ ID NO: 1983 - DNA, 25 bp, Homo sapiens
gtgaacgggcgccatcccgaggctt

SEQ ID NO: 1984 - DNA, 21 bp, Homo sapiens
atagtagaccgtatagcgtac

SEQ ID NO: 1985 - DNA, 21 bp, Homo sapiens
atggttgaccagagagcacac

SEQ ID NO: 1986 - DNA, 21 bp, Homo sapiens
aatattatacagtcaacctct

SEQ ID NO: 1987 - DNA, 21 bp, Homo sapiens
agcagcattgtacagggctat

SEQ ID NO: 1988 - DNA, 24 bp, Homo sapiens
agagcttagctgattggtgaacag

SEQ ID NO: 1989 - DNA, 23 bp, Homo sapiens
gatactgtaaacgctttctgatg

SEQ ID NO: 1990 - DNA, 22 bp, Homo sapiens
ttgcaggtcgtcttgcagggct

SEQ ID NO: 1991 - DNA, 21 bp, Homo sapiens
tgcaacttacctgagtcattg

SEQ ID NO: 1992 - DNA, 22 bp, Homo sapiens
tttcagtcagatgtttgctgct

SEQ ID NO: 1993 - DNA, 24 bp, Homo sapiens
tagtgcaatattgcttatagggtt

SEQ ID NO: 1994 - DNA, 21 bp, Homo sapiens
gtagattctccttctatgagt

SEQ ID NO: 1995 - DNA, 22 bp, Homo sapiens
tgtcttgcaggccgtcatgcag

SEQ ID NO: 1996 - DNA, 22 bp, Homo sapiens
ttcacagggaggtgtcatttat

SEQ ID NO: 1997 - DNA, 20 bp, Homo sapiens
aagtcaggtactcgaatgga

SEQ ID NO: 1998 - DNA, 21 bp, Homo sapiens
acttaaacgtggatgtacttg

SEQ ID NO: 1999 - DNA, 21 bp, Homo sapiens
aagtgcttatagtgcaggtag

SEQ ID NO: 2000 - DNA, 20 bp, Homo sapiens
attgcacggtatccatctgt

SEQ ID NO: 2001 - DNA, 21 bp, Homo sapiens
atcggatccgtctgagcttgg

SEQ ID NO: 2002 - DNA, 22 bp, Homo sapiens
aatcctttgtccctgggtgaga

SEQ ID NO: 2003 - DNA, 22 bp, Homo sapiens
caagtgcttccttttagagggt

SEQ ID NO: 2004 - DNA, 23 bp, Homo sapiens
gacctctgaaattcagttcttca

SEQ ID NO: 2005 - DNA, 20 bp, Homo sapiens
ggatatcatcatatactgta

SEQ ID NO: 2006 - DNA, 21 bp, Homo sapiens
ttttgcaccttttggagtgaa

SEQ ID NO: 2007 - DNA, 22 bp, Homo sapiens
gtaactggttgaacaactgaac

SEQ ID NO: 2008 - DNA, 21 bp, Homo sapiens
atcatagaggaaaatccatgt

SEQ ID NO: 2009 - DNA, 25 bp, Homo sapiens
tagcagcacgtaaatattggcgtag

SEQ ID NO: 2010 - DNA, 24 bp, Homo sapiens
gctggtttcacatggtggcttaga

SEQ ID NO: 2011 - DNA, 21 bp, Homo sapiens
tcagttatcacagtgctgatg

SEQ ID NO: 2012 - DNA, 22 bp, Homo sapiens
caaagcgctcccctttagaggt

SEQ ID NO: 2013 - DNA, 23 bp, Homo sapiens
caacattcattgctgtcggtggg

SEQ ID NO: 2014 - DNA, 20 bp, Homo sapiens
ttgcaggtcgtcttgcaggg

SEQ ID NO: 2015 - DNA, 20 bp, Homo sapiens
tgaggtaggaggttgtatag

SEQ ID NO: 2016 - DNA, 24 bp, Homo sapiens
tgaggtagtagattgtatagttgt

SEQ ID NO: 2017 - DNA, 20 bp, Homo sapiens
tagtgtttcctactttatgg

SEQ ID NO: 2018 - DNA, 22 bp, Homo sapiens
catcccttgcatggtggagggt

SEQ ID NO: 2019 - DNA, 23 bp, Homo sapiens
ttataatacaacctgataagtgt

SEQ ID NO: 2020 - DNA, 23 bp, Homo sapiens
actagactgaagctccttgagga

SEQ ID NO: 2021 - DNA, 20 bp, Homo sapiens
ctctaagaagttgactgaag

SEQ ID NO: 2022 - DNA, 24 bp, Homo sapiens
ctttggttatctagctgtatgagt

SEQ ID NO: 2023 - DNA, 21 bp, Homo sapiens
gctttcagtcggatgtttaca

SEQ ID NO: 2024 - DNA, 22 bp, Homo sapiens
ctttttgcggtctgggcttgct

SEQ ID NO: 2025 - DNA, 20 bp, Homo sapiens
aatgcacctgggcaaggatt

SEQ ID NO: 2026 - DNA, 23 bp, Homo sapiens
tcactcctctcctcccgtcttct

SEQ ID NO: 2027 - DNA, 22 bp, Homo sapiens
gaccgatttctcctggtgttca

SEQ ID NO: 2028 - DNA, 23 bp, Homo sapiens
gtacagtactgtgataactgaag

SEQ ID NO: 2029 - DNA, 21 bp, Homo sapiens
ggatgttggcctagttctgtg

SEQ ID NO: 2030 - DNA, 25 bp, Homo sapiens
ttgcagctgcctgggagtgacttca

SEQ ID NO: 2031 - DNA, 23 bp, Homo sapiens
gtatggcactggtagaattcact

SEQ ID NO: 2032 - DNA, 22 bp, Homo sapiens
tggtcgaccagttggaaagtaa

SEQ ID NO: 2033 - DNA, 21 bp, Homo sapiens
tactgcagacgtggcaatcat

SEQ ID NO: 2034 - DNA, 22 bp, Homo sapiens
ttggcagtgtcttagctggttg

SEQ ID NO: 2035 - DNA, 21 bp, Homo sapiens
caaatgctcagactcctgtgg

SEQ ID NO: 2036 - DNA, 24 bp, Homo sapiens
aatcctttgtccctgggtgagagt

SEQ ID NO: 2037 - DNA, 21 bp, Homo sapiens
agaggtagtaggttgcatagt

SEQ ID NO: 2038 - DNA, 19 bp, Homo sapiens
tgattggtacgtctgtggg

SEQ ID NO: 2039 - DNA, 22 bp, Homo sapiens
aacacacctggttaacctcttt

SEQ ID NO: 2040 - DNA, 20 bp, Homo sapiens
taacagtctacagccatggt

SEQ ID NO: 2041 - DNA, 21 bp, Homo sapiens
ctcagtagccagtgtagatcc

SEQ ID NO: 2042 - DNA, 19 bp, Homo sapiens
ctttggttatctagctgta

SEQ ID NO: 2043 - DNA, 20 bp, Homo sapiens
taaggcacgcggtgaatgcc

SEQ ID NO: 2044 - DNA, 21 bp, Homo sapiens
aatcacattgccagggatttc

SEQ ID NO: 2045 - DNA, 23 bp, Homo sapiens
gatatcatcatatactgtaagtt

SEQ ID NO: 2046 - DNA, 22 bp, Homo sapiens
agacgggaggaaagaagggagt

SEQ ID NO: 2047 - DNA, 18 bp, Homo sapiens
tacagtatagatgatgta

SEQ ID NO: 2048 - DNA, 24 bp, Homo sapiens
taactggttgaacaactgaaccca

SEQ ID NO: 2049 - DNA, 21 bp, Homo sapiens
ctgtgggccacctagtcacca

SEQ ID NO: 2050 - DNA, 22 bp, Homo sapiens
atggtttaccgtcccacataca

SEQ ID NO: 2051 - DNA, 22 bp, Homo sapiens
agagttgagtctggacgtcccg

SEQ ID NO: 2052 - DNA, 18 bp, Homo sapiens
ctttggttatctagctgt

SEQ ID NO: 2053 - DNA, 20 bp, Homo sapiens
cgctccagccctgccggggc

SEQ ID NO: 2054 - DNA, 21 bp, Homo sapiens
actctagagggaagcgctttc

SEQ ID NO: 2055 - DNA, 21 bp, Homo sapiens
aacacacctggttaacctctt

SEQ ID NO: 2056 - DNA, 20 bp, Homo sapiens
aactagactgtgagcttcta

SEQ ID NO: 2057 - DNA, 22 bp, Homo sapiens
tccagcatcagtgattttgttg

SEQ ID NO: 2058 - DNA, 22 bp, Homo sapiens
cctctagatggaagcactgtct

SEQ ID NO: 2059 - DNA, 21 bp, Homo sapiens
ttatcagaatctccaggggta

SEQ ID NO: 2060 - DNA, 20 bp, Homo sapiens
ataaagtagaaagcactact

SEQ ID NO: 2061 - DNA, 21 bp, Homo sapiens
tcggggatcatcatgtcacga

SEQ ID NO: 2062 - DNA, 21 bp, Homo sapiens
tgaggtagtaggttgtatggt

SEQ ID NO: 2063 - DNA, 22 bp, Homo sapiens
ttctctgttttggccatgtgtg

SEQ ID NO: 2064 - DNA, 21 bp, Homo sapiens
cgtgtcttgtgttgcagccgg

SEQ ID NO: 2065 - DNA, 20 bp, Homo sapiens
taaagtgcttatagtgcagg

SEQ ID NO: 2066 - DNA, 21 bp, Homo sapiens
cttggcacctagcaagcactc

SEQ ID NO: 2067 - DNA, 21 bp, Homo sapiens
cggatccgtctgagcttggct

SEQ ID NO: 2068 - DNA, 20 bp, Homo sapiens
aatggcgccactagggttgt

SEQ ID NO: 2069 - DNA, 24 bp, Homo sapiens
ctggtttcacatggtggcttagat

SEQ ID NO: 2070 - DNA, 20 bp, Homo sapiens
cctcccacacccaaggcttg

SEQ ID NO: 2071 - DNA, 23 bp, Homo sapiens
ttgcagctgcctgggagtgactt

SEQ ID NO: 2072 - DNA, 22 bp, Homo sapiens
attgcacggtatccatctgtaa

SEQ ID NO: 2073 - DNA, 22 bp, Homo sapiens
atccgcgctctgactctctgcc

SEQ ID NO: 2074 - DNA, 20 bp, Homo sapiens
tttgtgacctggtccactaa

SEQ ID NO: 2075 - DNA, 22 bp, Homo sapiens
cttaaacgtggatgtacttgct

SEQ ID NO: 2076 - DNA, 23 bp, Homo sapiens
ctccagcatcagtgattttgttg

SEQ ID NO: 2077 - DNA, 25 bp, Homo sapiens
agcagcattgtacagggctatgaag

SEQ ID NO: 2078 - DNA, 22 bp, Homo sapiens
ttaaacgtggatgtacttgctt

SEQ ID NO: 2079 - DNA, 23 bp, Homo sapiens
ctttttgcggtctgggcttgctg

SEQ ID NO: 2080 - DNA, 22 bp, Homo sapiens
cattattacttttggtacgcgc

SEQ ID NO: 2081 - DNA, 20 bp, Homo sapiens
taattttatgtataagctag

SEQ ID NO: 2082 - DNA, 22 bp, Homo sapiens
ctccagagggatgcactttctc

SEQ ID NO: 2083 - DNA, 22 bp, Homo sapiens
tgtgcctttggactacatcgtg

SEQ ID NO: 2084 - DNA, 20 bp, Homo sapiens
cctgttctccattacttggc

SEQ ID NO: 2085 - DNA, 22 bp, Homo sapiens
caccttgcgctactcaggtctg

SEQ ID NO: 2086 - DNA, 22 bp, Homo sapiens
tcaggctcagtcccctcccgat

SEQ ID NO: 2087 - DNA, 20 bp, Homo sapiens
gtgtcagtttgtcaaatacc

SEQ ID NO: 2088 - DNA, 24 bp, Homo sapiens
tgaggtagtaggttgtatggttta

SEQ ID NO: 2089 - DNA, 20 bp, Homo sapiens
atggttgaccagagagcaca

SEQ ID NO: 2090 - DNA, 21 bp, Homo sapiens
aatgctcagactcctgtggtg

SEQ ID NO: 2091 - DNA, 20 bp, Homo sapiens
gcagcacataatggtttgtg

SEQ ID NO: 2092 - DNA, 21 bp, Homo sapiens
aacattcattgctgtcggtgg

SEQ ID NO: 2093 - DNA, 25 bp, Homo sapiens
taccctgtagatccgaatttgtgta

SEQ ID NO: 2094 - DNA, 18 bp, Homo sapiens
actcaaactgtgggggca

SEQ ID NO: 2095 - DNA, 20 bp, Homo sapiens
tctctgggcctgtgtcttag

SEQ ID NO: 2096 - DNA, 20 bp, Homo sapiens
tgaggtagtaagttgtattg

SEQ ID NO: 2097 - DNA, 19 bp, Homo sapiens
tgaggtagtaggttgtgtg

SEQ ID NO: 2098 - DNA, 22 bp, Homo sapiens
tgagtgtactgtgggcttcgga

SEQ ID NO: 2099 - DNA, 23 bp, Homo sapiens
tactctggagagtgacaatcatg

SEQ ID NO: 2100 - DNA, 22 bp, Homo sapiens
gggagccaggaagtattgatgt

SEQ ID NO: 2101 - DNA, 22 bp, Homo sapiens
tgaggagatcgtcgaggttggc

SEQ ID NO: 2102 - DNA, 20 bp, Homo sapiens
ctgtatgccctcaccgctca

SEQ ID NO: 2103 - DNA, 28 bp, Homo sapiens
taaacgtggatgtacttgctttgaaact

SEQ ID NO: 2104 - DNA, 19 bp, Homo sapiens
tactcaaaaagctgtcagt

SEQ ID NO: 2105 - DNA, 19 bp, Homo sapiens
actctttccctgttgcact

SEQ ID NO: 2106 - DNA, 22 bp, Homo sapiens
ctcttgagggaagcactttctg

SEQ ID NO: 2107 - DNA, 24 bp, Homo sapiens
tactagactgaagctccttgagga

SEQ ID NO: 2108 - DNA, 21 bp, Homo sapiens
tacagtactgtgataactgaa

SEQ ID NO: 2109 - DNA, 19 bp, Homo sapiens
cccataaagtagaaagcac

SEQ ID NO: 2110 - DNA, 21 bp, Homo sapiens
gcaaagcacacggcctgcaga

SEQ ID NO: 2111 - DNA, 21 bp, Homo sapiens
tcaaatgctcagactcctgtg

SEQ ID NO: 2112 - DNA, 22 bp, Homo sapiens
acgcccttcccccccttcttca

SEQ ID NO: 2113 - DNA, 21 bp, Homo sapiens
ccactgccccaggtgctgctg

SEQ ID NO: 2114 - DNA, 23 bp, Homo sapiens
agcttctttacagtgttgccttg

SEQ ID NO: 2115 - DNA, 21 bp, Homo sapiens
tcttctctgttttggccatgt

SEQ ID NO: 2116 - DNA, 25 bp, Homo sapiens
tggcaacaccagtcgatgggctgtc

SEQ ID NO: 2117 - DNA, 22 bp, Homo sapiens
tctttggttatctagctgtatg

SEQ ID NO: 2118 - DNA, 17 bp, Homo sapiens
tgcaacgaacctgagcc

SEQ ID NO: 2119 - DNA, 20 bp, Homo sapiens
aacatagaggaaattccacg

SEQ ID NO: 2120 - DNA, 23 bp, Homo sapiens
cagtgcaatgatattgtcaaagc

SEQ ID NO: 2121 - DNA, 23 bp, Homo sapiens
gtataggcctttagatcatctga

SEQ ID NO: 2122 - DNA, 23 bp, Homo sapiens
cctggactgagccgtgctactgg

SEQ ID NO: 2123 - DNA, 20 bp, Homo sapiens
ttcacagggaggtgtcattt

SEQ ID NO: 2124 - DNA, 23 bp, Homo sapiens
actcaaaacccttcagtgacttc

SEQ ID NO: 2125 - DNA, 23 bp, Homo sapiens
taatgctaatcgtgataggggtt

SEQ ID NO: 2126 - DNA, 19 bp, Homo sapiens
gcccctgggcctatcctag

SEQ ID NO: 2127 - DNA, 23 bp, Homo sapiens
tccctgagaccctttaacctgtg

SEQ ID NO: 2128 - DNA, 24 bp, Homo sapiens
tcagtgcactacagaactttgtct

SEQ ID NO: 2129 - DNA, 23 bp, Homo sapiens
tgagtaccgccatgtctgttggg

SEQ ID NO: 2130 - DNA, 17 bp, Homo sapiens
ttatcagaatctccagg

SEQ ID NO: 2131 - DNA, 19 bp, Homo sapiens
ttgtgcttgatctaaccat

SEQ ID NO: 2132 - DNA, 17 bp, Homo sapiens
gtactgtgataactgaa

SEQ ID NO: 2133 - DNA, 21 bp, Homo sapiens
ctttcagtcggatgtttgcag

SEQ ID NO: 2134 - DNA, 19 bp, Homo sapiens
tatacgacctgctgccttt

SEQ ID NO: 2135 - DNA, 22 bp, Homo sapiens
atcactaaccacacggccaggt

SEQ ID NO: 2136 - DNA, 22 bp, Homo sapiens
aaaagtgcttacagtgcaggta

SEQ ID NO: 2137 - DNA, 16 bp, Homo sapiens
tccttcattccaccgg

SEQ ID NO: 2138 - DNA, 20 bp, Homo sapiens
cccgtagatccgatcttgtg

SEQ ID NO: 2139 - DNA, 18 bp, Homo sapiens
aacaggtgactggttaga

SEQ ID NO: 2140 - DNA, 23 bp, Homo sapiens
gcagtccatgggcatatacactt

SEQ ID NO: 2141 - DNA, 19 bp, Homo sapiens
gaagatctcaggctgtgtc

SEQ ID NO: 2142 - DNA, 23 bp, Homo sapiens
gttgaggtagtaggttgtatggt

SEQ ID NO: 2143 - DNA, 23 bp, Homo sapiens
aaaagctgggttgagagggcgaa

SEQ ID NO: 2144 - DNA, 21 bp, Homo sapiens
atatagggattggagccgtgg

SEQ ID NO: 2145 - DNA, 22 bp, Homo sapiens
ctgtgcgtgtgacagcggctga

SEQ ID NO: 2146 - DNA, 21 bp, Homo sapiens
tgctatgccaacatattgcca

SEQ ID NO: 2147 - DNA, 19 bp, Homo sapiens
tcattccaccggagtctgt

SEQ ID NO: 2148 - DNA, 18 bp, Homo sapiens
tcattccaccggagtctg

SEQ ID NO: 2149 - DNA, 22 bp, Homo sapiens
attgcacttgtcccggcctgtg

SEQ ID NO: 2150 - DNA, 17 bp, Homo sapiens
accctgtagaaccgaat

SEQ ID NO: 2151 - DNA, 22 bp, Homo sapiens
aaagtgcatccttttagaggtt

SEQ ID NO: 2152 - DNA, 21 bp, Homo sapiens
atgcacctgggcaaggattct

SEQ ID NO: 2153 - DNA, 21 bp, Homo sapiens
ctcccaacccttgtaccagtg

SEQ ID NO: 2154 - DNA, 18 bp, Homo sapiens
cactggtagaattcactg

SEQ ID NO: 2155 - DNA, 22 bp, Homo sapiens
agatgggctttcagtcggatgt

SEQ ID NO: 2156 - DNA, 22 bp, Homo sapiens
aaacgccattatcacactaaat

SEQ ID NO: 2157 - DNA, 22 bp, Homo sapiens
tacagtactgtgataactgaag

SEQ ID NO: 2158 - DNA, 21 bp, Homo sapiens
cctctgaaattcagttcttca

SEQ ID NO: 2159 - DNA, 23 bp, Homo sapiens
ttgaggtagtaggttgtatagtt

SEQ ID NO: 2160 - DNA, 19 bp, Homo sapiens
ttatcagaatctccagggg

SEQ ID NO: 2161 - DNA, 19 bp, Homo sapiens
gcaccatctgaaatcggtt

SEQ ID NO: 2162 - DNA, 19 bp, Homo sapiens
taacactgtctggtaacga

SEQ ID NO: 2163 - DNA, 24 bp, Homo sapiens
ttctccaaaagaaagcactttctg

SEQ ID NO: 2164 - DNA, 18 bp, Homo sapiens
tgattggtacgtctgtgg

SEQ ID NO: 2165 - DNA, 17 bp, Homo sapiens
gagatgaagcactgtag

SEQ ID NO: 2166 - DNA, 22 bp, Homo sapiens
ttttcaactctaatgggagaga

SEQ ID NO: 2167 - DNA, 22 bp, Homo sapiens
gaataatacatggttgatcttt

SEQ ID NO: 2168 - DNA, 22 bp, Homo sapiens
tgtaaacatcctacactctcag

SEQ ID NO: 2169 - DNA, 22 bp, Homo sapiens
gtgcctactgagctgatatcag

SEQ ID NO: 2170 - DNA, 19 bp, Homo sapiens
tagcagcacagaaatattg

SEQ ID NO: 2171 - DNA, 22 bp, Homo sapiens
cacagtggtctctgggattatg

SEQ ID NO: 2172 - DNA, 22 bp, Homo sapiens
actttaacatggaagtgctttc

SEQ ID NO: 2173 - DNA, 23 bp, Homo sapiens
tactgcagtgaaggcacttgtag

SEQ ID NO: 2174 - DNA, 21 bp, Homo sapiens
ggggtgctatctgtgattgag

SEQ ID NO: 2175 - DNA, 18 bp, Homo sapiens
ctagcaccatctgaaatc

SEQ ID NO: 2176 - DNA, 17 bp, Homo sapiens
acatcctcgactggaag

SEQ ID NO: 2177 - DNA, 24 bp, Homo sapiens
tccctgtcctccaggagctcacgt

SEQ ID NO: 2178 - DNA, 23 bp, Homo sapiens
cccagataatggcactctcaaac

SEQ ID NO: 2179 - DNA, 19 bp, Homo sapiens
aatggtagaactcacactg

SEQ ID NO: 2180 - DNA, 21 bp, Homo sapiens
cctgtagatccgaatttgtgt

SEQ ID NO: 2181 - DNA, 24 bp, Homo sapiens
tgaggtagtagtttgtgctgttgg

SEQ ID NO: 2182 - DNA, 19 bp, Homo sapiens
gacacgatcactcccgttg

SEQ ID NO: 2183 - DNA, 23 bp, Homo sapiens
ctcgtgtcttgtgttgcagccgg

SEQ ID NO: 2184 - DNA, 22 bp, Homo sapiens
caaagtgctcatagtgcaggta

SEQ ID NO: 2185 - DNA, 21 bp, Homo sapiens
caaagtgctgttcgtgcaggt

SEQ ID NO: 2186 - DNA, 19 bp, Homo sapiens
catgccttgagtgtaggac

SEQ ID NO: 2187 - DNA, 17 bp, Homo sapiens
ttcaagtaatccaggat

SEQ ID NO: 2188 - DNA, 23 bp, Homo sapiens
ccgcactgtgggtacttgctgct

SEQ ID NO: 2189 - DNA, 19 bp, Homo sapiens
cccgtagatccgatcttgt

SEQ ID NO: 2190 - DNA, 20 bp, Homo sapiens
ctgtagatccgaatttgtgt

SEQ ID NO: 2191 - DNA, 20 bp, Homo sapiens
aatgcacccgggcaaggatt

SEQ ID NO: 2192 - DNA, 21 bp, Homo sapiens
tatgccaacatattgccatct

SEQ ID NO: 2193 - DNA, 21 bp, Homo sapiens
ctaatactgccgggtaatgat

SEQ ID NO: 2194 - DNA, 24 bp, Homo sapiens
ctgtgcaaatccatgcaaaactga

SEQ ID NO: 2195 - DNA, 22 bp, Homo sapiens
tgtagggatggaagccatgaaa

SEQ ID NO: 2196 - DNA, 17 bp, Homo sapiens
tagcaccatttgaaatc

SEQ ID NO: 2197 - DNA, 21 bp, Homo sapiens
agcaccatctgaaatcggtta

SEQ ID NO: 2198 - DNA, 22 bp, Homo sapiens
tgctcaggttgcacagctggga

SEQ ID NO: 2199 - DNA, 25 bp, Homo sapiens
tacagtagtctgcacattggttaga

SEQ ID NO: 2200 - DNA, 20 bp, Homo sapiens
tgattgtccaaacgcaattc

SEQ ID NO: 2201 - DNA, 20 bp, Homo sapiens
aacaccagtcgatgggctgt

SEQ ID NO: 2202 - DNA, 20 bp, Homo sapiens
tcacagtggctaagttccgc

SEQ ID NO: 2203 - DNA, 23 bp, Homo sapiens
ttgcaacgaacctgagccactga

SEQ ID NO: 2204 - DNA, 21 bp, Homo sapiens
tgtatgccctcaccgctcagc

SEQ ID NO: 2205 - DNA, 22 bp, Homo sapiens
ggtgcctactgagctgatatca

SEQ ID NO: 2206 - DNA, 23 bp, Homo sapiens
tcctgtactgagctgccccgagg

SEQ ID NO: 2207 - DNA, 22 bp, Homo sapiens
gattgacacttctgtgagtaga

SEQ ID NO: 2208 - DNA, 23 bp, Homo sapiens
tggaatgtaaggaagtgtgtggt

SEQ ID NO: 2209 - DNA, 21 bp, Homo sapiens
tctgacctatgaattgacagc

SEQ ID NO: 2210 - DNA, 19 bp, Homo sapiens
caccagtcgatgggctgtc

SEQ ID NO: 2211 - DNA, 19 bp, Homo sapiens
tgtcttgcaggccgtcatg

SEQ ID NO: 2212 - DNA, 22 bp, Homo sapiens
aaaatggttccctttagagtgt

SEQ ID NO: 2213 - DNA, 20 bp, Homo sapiens
cctgtagatccgaatttgtg

SEQ ID NO: 2214 - DNA, 23 bp, Homo sapiens
tcaaagtgcttacagtgcaggta

SEQ ID NO: 2215 - DNA, 23 bp, Homo sapiens
acaagtcaggctcttgggaccta

SEQ ID NO: 2216 - DNA, 19 bp, Homo sapiens
caaaccagacttttcctag

SEQ ID NO: 2217 - DNA, 22 bp, Homo sapiens
aggcagtgtcattagctgattg

SEQ ID NO: 2218 - DNA, 20 bp, Homo sapiens
agctcggtctgaggcccctc

SEQ ID NO: 2219 - DNA, 19 bp, Homo sapiens
cagtgcaatgttaaaaggg

SEQ ID NO: 2220 - DNA, 22 bp, Homo sapiens
gtccagttttcccaggaatccc

SEQ ID NO: 2221 - DNA, 21 bp, Homo sapiens
ctgacctatgaattgacagcc

SEQ ID NO: 2222 - DNA, 21 bp, Homo sapiens
aacccgtagatccgatcttgt

SEQ ID NO: 2223 - DNA, 17 bp, Homo sapiens
tttggttatctagctgt

SEQ ID NO: 2224 - DNA, 23 bp, Homo sapiens
tgagcgcctcgacgacagagccg

SEQ ID NO: 2225 - DNA, 21 bp, Homo sapiens
gtccagttttcccaggaatcc

SEQ ID NO: 2226 - DNA, 20 bp, Homo sapiens
gctcagttcagcaggaacag

SEQ ID NO: 2227 - DNA, 19 bp, Homo sapiens
ctgcttgctctggtggaga

SEQ ID NO: 2228 - DNA, 23 bp, Homo sapiens
tgttcctctgtctcccagactct

SEQ ID NO: 2229 - DNA, 21 bp, Homo sapiens
acaccagtcgatgggctgtct

SEQ ID NO: 2230 - DNA, 20 bp, Homo sapiens
cattcaacgctgtcggtgag

SEQ ID NO: 2231 - DNA, 21 bp, Homo sapiens
agtgcctgagggagtaagagc

SEQ ID NO: 2232 - DNA, 17 bp, Homo sapiens
ctagtgattttgttgtt

SEQ ID NO: 2233 - DNA, 19 bp, Homo sapiens
ggctcagttcagcaggaac

SEQ ID NO: 2234 - DNA, 23 bp, Homo sapiens
cagtagtctgcacattggttaga

SEQ ID NO: 2235 - DNA, 21 bp, Homo sapiens
tggtgggcacagaatctggac

SEQ ID NO: 2236 - DNA, 19 bp, Homo sapiens
ttggcaatggtagaactca

SEQ ID NO: 2237 - DNA, 19 bp, Homo sapiens
actgtctggtaaagatggc

SEQ ID NO: 2238 - DNA, 19 bp, Homo sapiens
gcctctgctgctggccaga

SEQ ID NO: 2239 - DNA, 20 bp, Homo sapiens
aatggtagaactcacactgg

SEQ ID NO: 2240 - DNA, 20 bp, Homo sapiens
gtaccgtgagtaataatgcg

SEQ ID NO: 2241 - DNA, 23 bp, Homo sapiens
tcagaacaaatgccggttcccag

SEQ ID NO: 2242 - DNA, 22 bp, Homo sapiens
gctcttttcacattgtgctact

SEQ ID NO: 2243 - DNA, 21 bp, Homo sapiens
tgggagaaggctgtttactct

SEQ ID NO: 2244 - DNA, 16 bp, Homo sapiens
gtaatccaggataggc

SEQ ID NO: 2245 - DNA, 23 bp, Homo sapiens
atgcacccgggcaaggattctga

SEQ ID NO: 2246 - DNA, 19 bp, Homo sapiens
tgcacagatctcagacatc

SEQ ID NO: 2247 - DNA, 22 bp, Homo sapiens
tgtcgattggacccgccctccg

SEQ ID NO: 2248 - DNA, 21 bp, Homo sapiens
ccagtgttcagactacctgtt

SEQ ID NO: 2249 - DNA, 19 bp, Homo sapiens
agctgccagttgaagaact

SEQ ID NO: 2250 - DNA, 20 bp, Homo sapiens
ctctggagggaagcactttc

SEQ ID NO: 2251 - DNA, 19 bp, Homo sapiens
tgagaactgaattccatag

SEQ ID NO: 2252 - DNA, 23 bp, Homo sapiens
taccacagggtagaaccacggac

SEQ ID NO: 2253 - DNA, 22 bp, Homo sapiens
aaccatcgaccgttgattgtac

SEQ ID NO: 2254 - DNA, 18 bp, Homo sapiens
caagctcgtgtctgtggg

SEQ ID NO: 2255 - DNA, 24 bp, Homo sapiens
tgagaactgaattccataggctgt

SEQ ID NO: 2256 - DNA, 20 bp, Homo sapiens
ctgccaattccataggtcac

SEQ ID NO: 2257 - DNA, 23 bp, Homo sapiens
catggctgtaccaccttgtcggg

SEQ ID NO: 2258 - DNA, 20 bp, Homo sapiens
ctgtacaggccactgccttg

SEQ ID NO: 2259 - DNA, 21 bp, Homo sapiens
tttggcaatggtagaactcac

SEQ ID NO: 2260 - DNA, 20 bp, Homo sapiens
aactgaattccataggctgt

SEQ ID NO: 2261 - DNA, 20 bp, Homo sapiens
ctcccacatgcagggtttgc

SEQ ID NO: 2262 - DNA, 22 bp, Homo sapiens
aacacacctattcaaggattca

SEQ ID NO: 2263 - DNA, 20 bp, Homo sapiens
ttacagttgttcaaccagtt

SEQ ID NO: 2264 - DNA, 20 bp, Homo sapiens
cacagggtagaaccacggac

SEQ ID NO: 2265 - DNA, 22 bp, Homo sapiens
taatccttgctacctgggtgag

SEQ ID NO: 2266 - DNA, 22 bp, Homo sapiens
accctgtagaaccgaatttgtg

SEQ ID NO: 2267 - DNA, 21 bp, Homo sapiens
ctccagcatcagtgattttgt

SEQ ID NO: 2268 - DNA, 23 bp, Homo sapiens
ccagttaccgcttccgctaccgc

SEQ ID NO: 2269 - DNA, 21 bp, Homo sapiens
aggcagtgtcattagctgatt

SEQ ID NO: 2270 - DNA, 22 bp, Homo sapiens
tgggtctttgcgggcgagatga

SEQ ID NO: 2271 - DNA, 23 bp, Homo sapiens
tacagcaggcacagacaggcagt

SEQ ID NO: 2272 - DNA, 20 bp, Homo sapiens
aatgacacgatcactcccgt

SEQ ID NO: 2273 - DNA, 21 bp, Homo sapiens
gtcatacacggctctcctctc

SEQ ID NO: 2274 - DNA, 20 bp, Homo sapiens
actcggcgtggcgtcggtcg

SEQ ID NO: 2275 - DNA, 21 bp, Homo sapiens
tactgcatcaggaactgattg

SEQ ID NO: 2276 - DNA, 24 bp, Homo sapiens
ataccctgtagatccgaatttgtg

SEQ ID NO: 2277 - DNA, 19 bp, Homo sapiens
cttcatgtgactcgtggac

SEQ ID NO: 2278 - DNA, 21 bp, Homo sapiens
acagtagtctgcacattggtt

SEQ ID NO: 2279 - DNA, 19 bp, Homo sapiens
aaatgtttaggaccactag

SEQ ID NO: 2280 - DNA, 20 bp, Homo sapiens
ggtagtaggttgtgtggttt

SEQ ID NO: 2281 - DNA, 21 bp, Homo sapiens
gtgcctactgagctgatatca

SEQ ID NO: 2282 - DNA, 20 bp, Homo sapiens
tctgacctatgaattgacag

SEQ ID NO: 2283 - DNA, 20 bp, Homo sapiens
ctgggagaaggctgtttact

SEQ ID NO: 2284 - DNA, 18 bp, Homo sapiens
gtagtaggttgtgtggtt

SEQ ID NO: 2285 - DNA, 20 bp, Homo sapiens
cacccgtagaaccgaccttg

SEQ ID NO: 2286 - DNA, 21 bp, Homo sapiens
ctttcagtcagatgtttgctg

SEQ ID NO: 2287 - DNA, 21 bp, Homo sapiens
taccctgtagaaccgaatttg

SEQ ID NO: 2288 - DNA, 21 bp, Homo sapiens
aatactgccgggtaatgatgg

SEQ ID NO: 2289 - DNA, 19 bp, Homo sapiens
atggtagaactcacactgg

SEQ ID NO: 2290 - DNA, 20 bp, Homo sapiens
tgctatgccaacatattgcc

SEQ ID NO: 2291 - DNA, 22 bp, Homo sapiens
atgcacctgggcaaggattctg

SEQ ID NO: 2292 - DNA, 21 bp, Homo sapiens
ttaagacttgcagtgatgttt

SEQ ID NO: 2293 - DNA, 22 bp, Homo sapiens
tagtagattgtatagttgtggg

SEQ ID NO: 2294 - DNA, 20 bp, Homo sapiens
tcgtgtcttgtgttgcagcc

SEQ ID NO: 2295 - DNA, 23 bp, Homo sapiens
gctggtttcatatggtggtttag

SEQ ID NO: 2296 - DNA, 17 bp, Homo sapiens
ctggactgagccgtgct

SEQ ID NO: 2297 - DNA, 20 bp, Homo sapiens
tagcaccatctgaaatcggt

SEQ ID NO: 2298 - DNA, 21 bp, Homo sapiens
aagtgcttccatgtttcagtg

SEQ ID NO: 2299 - DNA, 21 bp, Homo sapiens
gctggtttcatatggtggttt

SEQ ID NO: 2300 - DNA, 20 bp, Homo sapiens
ctggacttggagtcagaaga

SEQ ID NO: 2301 - DNA, 22 bp, Homo sapiens
aagcattctttcattggttggt

SEQ ID NO: 2302 - DNA, 22 bp, Homo sapiens
ctccatttgttttgatgatgga

SEQ ID NO: 2303 - DNA, 24 bp, Homo sapiens
taatactgcctggtaatgatgacg

SEQ ID NO: 2304 - DNA, 23 bp, Homo sapiens
aatgacacgatcactcccgttga

SEQ ID NO: 2305 - DNA, 21 bp, Homo sapiens
cctcagggctgtagaacaggg

SEQ ID NO: 2306 - DNA, 21 bp, Homo sapiens
ccttcattccaccggagtctg

SEQ ID NO: 2307 - DNA, 22 bp, Homo sapiens
tccctgtcctccaggagctcac

SEQ ID NO: 2308 - DNA, 19 bp, Homo sapiens
tgacctatgaattgacaga

SEQ ID NO: 2309 - DNA, 18 bp, Homo sapiens
aatgtttaggaccactag

SEQ ID NO: 2310 - DNA, 20 bp, Homo sapiens
tgttcctgagctgttggatt

SEQ ID NO: 2311 - DNA, 16 bp, Homo sapiens
accctgtagatccgaa

SEQ ID NO: 2312 - DNA, 22 bp, Homo sapiens
ggagtgtgacaatggtgtttgt

SEQ ID NO: 2313 - DNA, 19 bp, Homo sapiens
ctgtagaaccgaatttgtg

SEQ ID NO: 2314 - DNA, 22 bp, Homo sapiens
accatcgaccgttgattgtacc

SEQ ID NO: 2315 - DNA, 18 bp, Homo sapiens
accgttaccattactgag

SEQ ID NO: 2316 - DNA, 18 bp, Homo sapiens
tccctgagaccctaactt

SEQ ID NO: 2317 - DNA, 19 bp, Homo sapiens
cagcagcaattcatgtttt

SEQ ID NO: 2318 - DNA, 21 bp, Homo sapiens
tttcagtcggatgtttacagc

SEQ ID NO: 2319 - DNA, 17 bp, Homo sapiens
ctgtaccaccttgtcgg

SEQ ID NO: 2320 - DNA, 20 bp, Homo sapiens
tactcaaaaagctgtcagtc

SEQ ID NO: 2321 - DNA, 18 bp, Homo sapiens
ttgttcgttcggctcgcg

SEQ ID NO: 2322 - DNA, 21 bp, Homo sapiens
ggggttcctggggatgggatt

SEQ ID NO: 2323 - DNA, 18 bp, Homo sapiens
tggagtgtgacaatggtg

SEQ ID NO: 2324 - DNA, 24 bp, Homo sapiens
ctccagcatcagtgattttgttga

SEQ ID NO: 2325 - DNA, 21 bp, Homo sapiens
ggaggaaccttggagcttcgg

SEQ ID NO: 2326 - DNA, 20 bp, Homo sapiens
cagattcgattctaggggaa

SEQ ID NO: 2327 - DNA, 21 bp, Homo sapiens
tatcagactgatgttgactgt

SEQ ID NO: 2328 - DNA, 20 bp, Homo sapiens
ttgtagccttttggagtaga

SEQ ID NO: 2329 - DNA, 22 bp, Homo sapiens
tactgcagacagtggcaatcat

SEQ ID NO: 2330 - DNA, 19 bp, Homo sapiens
cacgctcatgcacacaccc

SEQ ID NO: 2331 - DNA, 19 bp, Homo sapiens
taaggcacgcggtgaatgc

SEQ ID NO: 2332 - DNA, 20 bp, Homo sapiens
ctcagtagccagtgtagatc

SEQ ID NO: 2333 - DNA, 17 bp, Homo sapiens
gcagtccatgggcatat

SEQ ID NO: 2334 - DNA, 21 bp, Homo sapiens
tcaccaccttctccacccagc

SEQ ID NO: 2335 - DNA, 20 bp, Homo sapiens
ttgcagctgcctgggagtga

SEQ ID NO: 2336 - DNA, 23 bp, Homo sapiens
aaccatcgaccgttgattgtacc

SEQ ID NO: 2337 - DNA, 23 bp, Homo sapiens
gagaattgtggctggacatctgt

SEQ ID NO: 2338 - DNA, 19 bp, Homo sapiens
tactgcctggtaatgatga

SEQ ID NO: 2339 - DNA, 19 bp, Homo sapiens
tgcacttgtctcggtctga

SEQ ID NO: 2340 - DNA, 20 bp, Homo sapiens
cactcctctcctcccgtctt

SEQ ID NO: 2341 - DNA, 19 bp, Homo sapiens
tttggtccccttcaaccag

SEQ ID NO: 2342 - DNA, 21 bp, Homo sapiens
tgacctatgaattgacagaca

SEQ ID NO: 2343 - DNA, 20 bp, Homo sapiens
tgaggggcagagagcgagac

SEQ ID NO: 2344 - DNA, 21 bp, Homo sapiens
gctgggaaggcaaagggacgt

SEQ ID NO: 2345 - DNA, 22 bp, Homo sapiens
atcatcgtctcaaatgagtctt

SEQ ID NO: 2346 - DNA, 24 bp, Homo sapiens
aggcagtgtcattagctgattgta

SEQ ID NO: 2347 - DNA, 17 bp, Homo sapiens
agcagcattgtacaggg

SEQ ID NO: 2348 - DNA, 22 bp, Homo sapiens
acagggtagaaccacggacagg

SEQ ID NO: 2349 - DNA, 23 bp, Homo sapiens
tagcaccatctgaaatcggttat

SEQ ID NO: 2350 - DNA, 21 bp, Homo sapiens
aagtgcttacagtgcaggtag

SEQ ID NO: 2351 - DNA, 21 bp, Homo sapiens
acccgtagatccgatcttgtg

SEQ ID NO: 2352 - DNA, 21 bp, Homo sapiens
ctccagagggaagcgctttct

SEQ ID NO: 2353 - DNA, 17 bp, Homo sapiens
tggctcagttcagcagg

SEQ ID NO: 2354 - DNA, 18 bp, Homo sapiens
tattgcacttgtcccggc

SEQ ID NO: 2355 - DNA, 18 bp, Homo sapiens
acgaacctgagccactga

SEQ ID NO: 2356 - DNA, 22 bp, Homo sapiens
caagaacctcagttgcttttgt

SEQ ID NO: 2357 - DNA, 20 bp, Homo sapiens
atactgcctggtaatgatga

SEQ ID NO: 2358 - DNA, 20 bp, Homo sapiens
tcacagtggctaagttctgc

SEQ ID NO: 2359 - DNA, 20 bp, Homo sapiens
tggaagactagtgattttgt

SEQ ID NO: 2360 - DNA, 19 bp, Homo sapiens
cacattgccagggattacc

SEQ ID NO: 2361 - DNA, 22 bp, Homo sapiens
tgtgaaatgtttaggaccacta

SEQ ID NO: 2362 - DNA, 23 bp, Homo sapiens
acattcaacgctgtcggtgagtt

SEQ ID NO: 2363 - DNA, 22 bp, Homo sapiens
gcttatcagactgatgttgact

SEQ ID NO: 2364 - DNA, 24 bp, Homo sapiens
tcagcaccaggatattgttggaga

SEQ ID NO: 2365 - DNA, 21 bp, Homo sapiens
atcactaactccactgccatc

SEQ ID NO: 2366 - DNA, 19 bp, Homo sapiens
tgttgtacttttttttttg

SEQ ID NO: 2367 - DNA, 24 bp, Homo sapiens
tagcttatcagactgatgttgact

SEQ ID NO: 2368 - DNA, 23 bp, Homo sapiens
taaagaggtatagggcatgggaa

SEQ ID NO: 2369 - DNA, 24 bp, Homo sapiens
caacattcattgctgtcggtgggt

SEQ ID NO: 2370 - DNA, 21 bp, Homo sapiens
atcttactgggcagcattgga

SEQ ID NO: 2371 - DNA, 23 bp, Homo sapiens
tctgtcatttctttaggccaata

SEQ ID NO: 2372 - DNA, 21 bp, Homo sapiens
tagcaccatttgaaatcggtt

SEQ ID NO: 2373 - DNA, 21 bp, Homo sapiens
cgtcttacccagcagtgtttg

SEQ ID NO: 2374 - DNA, 19 bp, Homo sapiens
taggtagtttcctgttgtt

SEQ ID NO: 2375 - DNA, 23 bp, Homo sapiens
ctatacgacctgctgcctttctt

SEQ ID NO: 2376 - DNA, 23 bp, Homo sapiens
atccccagatacaatggacaata

SEQ ID NO: 2377 - DNA, 20 bp, Homo sapiens
gaagttgttcgtggtggatt

SEQ ID NO: 2378 - DNA, 23 bp, Homo sapiens
agagcttagctgattggtgaaca

SEQ ID NO: 2379 - DNA, 20 bp, Homo sapiens
caggtcgtcttgcagggctt

SEQ ID NO: 2380 - DNA, 19 bp, Homo sapiens
aggcaagatgctggcatag

SEQ ID NO: 2381 - DNA, 23 bp, Homo sapiens
tcaacaaaatcactgatgctgga

SEQ ID NO: 2382 - DNA, 20 bp, Homo sapiens
agcagcaattcatgttttga

SEQ ID NO: 2383 - DNA, 20 bp, Homo sapiens
gtgactgcatgctcccaggt

SEQ ID NO: 2384 - DNA, 16 bp, Homo sapiens
tattgcacttgtcccg

SEQ ID NO: 2385 - DNA, 21 bp, Homo sapiens
tagtggatgatgcactctgtg

SEQ ID NO: 2386 - DNA, 23 bp, Homo sapiens
ggctcagtagccagtgtagatcc

SEQ ID NO: 2387 - DNA, 22 bp, Homo sapiens
tcttaccagacatggttagacc

SEQ ID NO: 2388 - DNA, 21 bp, Homo sapiens
ggagtgtgacaatggtgtttg

SEQ ID NO: 2389 - DNA, 21 bp, Homo sapiens
ccctgagaccctttaacctgt

SEQ ID NO: 2390 - DNA, 24 bp, Homo sapiens
tagcagcacgtaaatattggcgtt

SEQ ID NO: 2391 - DNA, 23 bp, Homo sapiens
ttggtccccttcaaccagctgta

SEQ ID NO: 2392 - DNA, 17 bp, Homo sapiens
tatggcactggtagaat

SEQ ID NO: 2393 - DNA, 20 bp, Homo sapiens
actgtagtatgggcacttcc

SEQ ID NO: 2394 - DNA, 21 bp, Homo sapiens
aaatctctgcaggcaaatgtg

SEQ ID NO: 2395 - DNA, 23 bp, Homo sapiens
caagtgcttccttttagagggtt

SEQ ID NO: 2396 - DNA, 17 bp, Homo sapiens
cagtagtctgcacattg

SEQ ID NO: 2397 - DNA, 19 bp, Homo sapiens
gtgctgttcgtgcaggtag

SEQ ID NO: 2398 - DNA, 19 bp, Homo sapiens
aacatcctcgactggaagc

SEQ ID NO: 2399 - DNA, 23 bp, Homo sapiens
agagttgagtctggacgtcccga

SEQ ID NO: 2400 - DNA, 22 bp, Homo sapiens
tactctggagagtgacaatcat

SEQ ID NO: 2401 - DNA, 23 bp, Homo sapiens
tcactggctcctttctgggtaga

SEQ ID NO: 2402 - DNA, 23 bp, Homo sapiens
aagaggtatagggcatgggaaaa

SEQ ID NO: 2403 - DNA, 21 bp, Homo sapiens
tgtgcgtgtgacagcggctga

SEQ ID NO: 2404 - DNA, 21 bp, Homo sapiens
gcaacgaacctgagccactga

SEQ ID NO: 2405 - DNA, 22 bp, Homo sapiens
tccccgactggaagctgtaaga

SEQ ID NO: 2406 - DNA, 21 bp, Homo sapiens
agttgttcgtggtggattcgc

SEQ ID NO: 2407 - DNA, 22 bp, Homo sapiens
aatcacattgccagggattacc

SEQ ID NO: 2408 - DNA, 21 bp, Homo sapiens
ctgtttgcagaggaaactgag

SEQ ID NO: 2409 - DNA, 21 bp, Homo sapiens
gagtctccagtaatggacggg

SEQ ID NO: 2410 - DNA, 21 bp, Homo sapiens
actggccctcaaagtcccgct

SEQ ID NO: 2411 - DNA, 18 bp, Homo sapiens
ctgtctggtaacgatgtt

SEQ ID NO: 2412 - DNA, 21 bp, Homo sapiens
ttctcgaggaaagaagcactt

SEQ ID NO: 2413 - DNA, 17 bp, Homo sapiens
cgaacctgagccactga

SEQ ID NO: 2414 - DNA, 21 bp, Homo sapiens
tccagttttcccaggaatccc

SEQ ID NO: 2415 - DNA, 20 bp, Homo sapiens
accaatattactgtgctgct

SEQ ID NO: 2416 - DNA, 22 bp, Homo sapiens
gagtgccttcttttggagcgtt

SEQ ID NO: 2417 - DNA, 17 bp, Homo sapiens
cagcaactccatgtgga

SEQ ID NO: 2418 - DNA, 21 bp, Homo sapiens
taatgctaatcgtgatagggg

SEQ ID NO: 2419 - DNA, 22 bp, Homo sapiens
aactagtaatgttggattaggg

SEQ ID NO: 2420 - DNA, 19 bp, Homo sapiens
cctgtagaaccgaatttgt

SEQ ID NO: 2421 - DNA, 21 bp, Homo sapiens
ggactccatttgttttgatga

SEQ ID NO: 2422 - DNA, 21 bp, Homo sapiens
tcgtgcatccctttagagtgt

SEQ ID NO: 2423 - DNA, 18 bp, Homo sapiens
atggtagaactcacactg

SEQ ID NO: 2424 - DNA, 22 bp, Homo sapiens
ttctagtaagagtggcagtcga

SEQ ID NO: 2425 - DNA, 19 bp, Homo sapiens
tgtgacagattgataactg

SEQ ID NO: 2426 - DNA, 24 bp, Homo sapiens
taggtagtttcatgttgttgggat

SEQ ID NO: 2427 - DNA, 20 bp, Homo sapiens
ggtagtagtttgtgctgttg

SEQ ID NO: 2428 - DNA, 22 bp, Homo sapiens
cagtgcaatgatattgtcaaag

SEQ ID NO: 2429 - DNA, 21 bp, Homo sapiens
tctcactgtagcctcgaaccc

SEQ ID NO: 2430 - DNA, 18 bp, Homo sapiens
tgtaaacatccccgactg

SEQ ID NO: 2431 - DNA, 24 bp, Homo sapiens
tgaacatccaggtctggggcatga

SEQ ID NO: 2432 - DNA, 19 bp, Homo sapiens
gtgcttatagtgcaggtag

SEQ ID NO: 2433 - DNA, 16 bp, Homo sapiens
tagcttatcagactga

SEQ ID NO: 2434 - DNA, 22 bp, Homo sapiens
gactatagaactttccccctca

SEQ ID NO: 2435 - DNA, 20 bp, Homo sapiens
tcgattggacccgccctccg

SEQ ID NO: 2436 - DNA, 20 bp, Homo sapiens
atcgggaatgtcgtgtccgc

SEQ ID NO: 2437 - DNA, 22 bp, Homo sapiens
tgtgatatcatggttcctggga

SEQ ID NO: 2438 - DNA, 20 bp, Homo sapiens
ttcagtcggatgtttacagc

SEQ ID NO: 2439 - DNA, 19 bp, Homo sapiens
tcacagtggctaagttctg

SEQ ID NO: 2440 - DNA, 21 bp, Homo sapiens
ctgcaaagggaagccctttct

SEQ ID NO: 2441 - DNA, 21 bp, Homo sapiens
cgtaccgtgagtaataatgcg

SEQ ID NO: 2442 - DNA, 21 bp, Homo sapiens
ttctcaagagggaggcaatca

SEQ ID NO: 2443 - DNA, 15 bp, Homo sapiens
tttgttcgttcggct

SEQ ID NO: 2444 - DNA, 22 bp, Homo sapiens
ctggggttctgagacagacagt

SEQ ID NO: 2445 - DNA, 21 bp, Homo sapiens
cacattgccagggatttccaa

SEQ ID NO: 2446 - DNA, 19 bp, Homo sapiens
ttacagttgttcaaccagt

SEQ ID NO: 2447 - DNA, 20 bp, Homo sapiens
ctacattgtctgctgggttt

SEQ ID NO: 2448 - DNA, 21 bp, Homo sapiens
ttgcacttgtcccggcctgtt

SEQ ID NO: 2449 - DNA, 24 bp, Homo sapiens
actcaaactgtgggggcactttct

SEQ ID NO: 2450 - DNA, 20 bp, Homo sapiens
ccctgtggactcagttctgg

SEQ ID NO: 2451 - DNA, 21 bp, Homo sapiens
atactgcctggtaatgatgac

SEQ ID NO: 2452 - DNA, 21 bp, Homo sapiens
agggggaaagttctatagtcc

SEQ ID NO: 2453 - DNA, 20 bp, Homo sapiens
taaagctagataaccgaaag

SEQ ID NO: 2454 - DNA, 19 bp, Homo sapiens
ctatacgacctgctgcctt

SEQ ID NO: 2455 - DNA, 19 bp, Homo sapiens
tggacggagaactgataag

SEQ ID NO: 2456 - DNA, 23 bp, Homo sapiens
tgagtgtactgtgggcttcggag

SEQ ID NO: 2457 - DNA, 21 bp, Homo sapiens
gaaatgtttaggaccactaga

SEQ ID NO: 2458 - DNA, 23 bp, Homo sapiens
tggacggagaactgataagggta

SEQ ID NO: 2459 - DNA, 22 bp, Homo sapiens
gaacatcacagcaagtctgtgc

SEQ ID NO: 2460 - DNA, 17 bp, Homo sapiens
tttcagtcggatgtttg

SEQ ID NO: 2461 - DNA, 19 bp, Homo sapiens
agtagtctgcacattggtt

SEQ ID NO: 2462 - DNA, 18 bp, Homo sapiens
cacattgccagggatttc

SEQ ID NO: 2463 - DNA, 20 bp, Homo sapiens
tcttctctgttttggccatg

SEQ ID NO: 2464 - DNA, 21 bp, Homo sapiens
gagatgaagcactgtagctca

SEQ ID NO: 2465 - DNA, 22 bp, Homo sapiens
ccactagattgtgagctcctgg

SEQ ID NO: 2466 - DNA, 22 bp, Homo sapiens
tcatcgtctcaaatgagtcttc

SEQ ID NO: 2467 - DNA, 20 bp, Homo sapiens
gaggtagtaggttgtgtggt

SEQ ID NO: 2468 - DNA, 23 bp, Homo sapiens
taatctcagctggcaactgtgag

SEQ ID NO: 2469 - DNA, 19 bp, Homo sapiens
acaagtcaggctcttggga

SEQ ID NO: 2470 - DNA, 24 bp, Homo sapiens
acaaagtgcttccctttagagtgt

SEQ ID NO: 2471 - DNA, 20 bp, Homo sapiens
actctagagggaagcgcttt

SEQ ID NO: 2472 - DNA, 22 bp, Homo sapiens
taatgctaatcgtgataggggt

SEQ ID NO: 2473 - DNA, 20 bp, Homo sapiens
aggcaagatgctggcatagc

SEQ ID NO: 2474 - DNA, 20 bp, Homo sapiens
gatgttggcctagttctgtg

SEQ ID NO: 2475 - DNA, 21 bp, Homo sapiens
atactgcatcaggaactgatt

SEQ ID NO: 2476 - DNA, 21 bp, Homo sapiens
gaggtagtagtttgtacagtt

SEQ ID NO: 2477 - DNA, 20 bp, Homo sapiens
taatgctaatcgtgataggg

SEQ ID NO: 2478 - DNA, 21 bp, Homo sapiens
tgcaggtcgtcttgcagggct

SEQ ID NO: 2479 - DNA, 20 bp, Homo sapiens
ttaaggcacgcggtgaatgc

SEQ ID NO: 2480 - DNA, 30 bp, Homo sapiens
cctcctgatgattcttcttcctgagcacgc

SEQ ID NO: 2481 - DNA, 18 bp, Homo sapiens
tggtagaactcacactgg

SEQ ID NO: 2482 - DNA, 20 bp, Homo sapiens
ggctcagttcagcaggaaca

SEQ ID NO: 2483 - DNA, 18 bp, Homo sapiens
ttttgttcgttcggctcg

SEQ ID NO: 2484 - DNA, 17 bp, Homo sapiens
ctcagttcagcaggaac

SEQ ID NO: 2485 - DNA, 21 bp, Homo sapiens
gtttttcattattgctcctga

SEQ ID NO: 2486 - DNA, 19 bp, Homo sapiens
acattcaacgctgtcggtg

SEQ ID NO: 2487 - DNA, 16 bp, Homo sapiens
tatcagactgatgttg

SEQ ID NO: 2488 - DNA, 22 bp, Homo sapiens
taccacagggtagaaccacgga

SEQ ID NO: 2489 - DNA, 18 bp, Homo sapiens
ccgcactgtgggtacttg

SEQ ID NO: 2490 - DNA, 24 bp, Homo sapiens
ggtgcagtgctgcatctctggtca

SEQ ID NO: 2491 - DNA, 21 bp, Homo sapiens
gagtgccttcttttggagcgt

SEQ ID NO: 2492 - DNA, 22 bp, Homo sapiens
agtggttcttaacagttcaaca

SEQ ID NO: 2493 - DNA, 19 bp, Homo sapiens
ccgtagaaccgaccttgcg

SEQ ID NO: 2494 - DNA, 22 bp, Homo sapiens
ggtccagttttcccaggaatcc

SEQ ID NO: 2495 - DNA, 22 bp, Homo sapiens
ttgcaacgaacctgagccactg

SEQ ID NO: 2496 - DNA, 19 bp, Homo sapiens
acccgtagaaccgaccttg

SEQ ID NO: 2497 - DNA, 19 bp, Homo sapiens
gttcgttcggctcgcgtga

SEQ ID NO: 2498 - DNA, 22 bp, Homo sapiens
ttcacagtggctaagttccgcc

SEQ ID NO: 2499 - DNA, 19 bp, Homo sapiens
tggaatgtaaagaagtatg

SEQ ID NO: 2500 - DNA, 19 bp, Homo sapiens
cgtcaacacttgctggttt

SEQ ID NO: 2501 - DNA, 21 bp, Homo sapiens
aagctcggtctgaggcccctc

SEQ ID NO: 2502 - DNA, 19 bp, Homo sapiens
actgtctggtaacgatgtt

SEQ ID NO: 2503 - DNA, 20 bp, Homo sapiens
tgtagtgtttcctactttat

SEQ ID NO: 2504 - DNA, 22 bp, Homo sapiens
taaggcacgcggtgaatgccaa

SEQ ID NO: 2505 - DNA, 21 bp, Homo sapiens
gtgtcagtttgtcaaataccc

SEQ ID NO: 2506 - DNA, 17 bp, Homo sapiens
ctgtagatccgaatttg

SEQ ID NO: 2507 - DNA, 20 bp, Homo sapiens
tgacacgatcactcccgttg

SEQ ID NO: 2508 - DNA, 22 bp, Homo sapiens
attattacttttggtacgcgct

SEQ ID NO: 2509 - DNA, 22 bp, Homo sapiens
ttaagacttgcagtgatgttta

SEQ ID NO: 2510 - DNA, 19 bp, Homo sapiens
cattgcacttgtctcggtc

SEQ ID NO: 2511 - DNA, 20 bp, Homo sapiens
tgtagggatggaagccatga

SEQ ID NO: 2512 - DNA, 22 bp, Homo sapiens
gaggtagtaggttgtgtggttt

SEQ ID NO: 2513 - DNA, 19 bp, Homo sapiens
gcactggtagaattcactg

SEQ ID NO: 2514 - DNA, 22 bp, Homo sapiens
taaagaggtatagggcatggga

SEQ ID NO: 2515 - DNA, 19 bp, Homo sapiens
gtaatccaggataggctgt

SEQ ID NO: 2516 - DNA, 20 bp, Homo sapiens
actccagccccacagcctca

SEQ ID NO: 2517 - DNA, 19 bp, Homo sapiens
gctgactcctagtccaggg

SEQ ID NO: 2518 - DNA, 25 bp, Homo sapiens
accctgtagaaccgaatttgtgtgg

SEQ ID NO: 2519 - DNA, 23 bp, Homo sapiens
aatcacattgccagggatttcca

SEQ ID NO: 2520 - DNA, 20 bp, Homo sapiens
ccacctcccctgcaaacgtc

SEQ ID NO: 2521 - DNA, 21 bp, Homo sapiens
ttctcaaggaggtgtcgttta

SEQ ID NO: 2522 - DNA, 20 bp, Homo sapiens
tcttaccggacagtgctgga

SEQ ID NO: 2523 - DNA, 17 bp, Homo sapiens
tttggcaatggtagaac

SEQ ID NO: 2524 - DNA, 18 bp, Homo sapiens
gctgggttgagagggcga

SEQ ID NO: 2525 - DNA, 19 bp, Homo sapiens
cactgtctggtaaagatgg

SEQ ID NO: 2526 - DNA, 22 bp, Homo sapiens
ccctgagaccctttaacctgtg

SEQ ID NO: 2527 - DNA, 24 bp, Homo sapiens
aatccttgctatctgggtgctagt

SEQ ID NO: 2528 - DNA, 19 bp, Homo sapiens
gtagtaggttgtgtggttt

SEQ ID NO: 2529 - DNA, 21 bp, Homo sapiens
caagtgcttccttttagaggg

SEQ ID NO: 2530 - DNA, 22 bp, Homo sapiens
cctattcttggttacttgcacg

SEQ ID NO: 2531 - DNA, 20 bp, Homo sapiens
acaggtgaggttcttgggag

SEQ ID NO: 2532 - DNA, 21 bp, Homo sapiens
ttatcagattgtattgtaatt

SEQ ID NO: 2533 - DNA, 23 bp, Homo sapiens
actagattgtgagctcctggagg

SEQ ID NO: 2534 - DNA, 21 bp, Homo sapiens
caaagcgctcccctttagagg

SEQ ID NO: 2535 - DNA, 19 bp, Homo sapiens
gccctgtggactcagttct

SEQ ID NO: 2536 - DNA, 20 bp, Homo sapiens
ctggccctcaaagtcccgct

SEQ ID NO: 2537 - DNA, 20 bp, Homo sapiens
aacgccattatcacactaaa

SEQ ID NO: 2538 - DNA, 18 bp, Homo sapiens
ctgtctggtaaagatggc

SEQ ID NO: 2539 - DNA, 19 bp, Homo sapiens
ggtagtaagttgtattgtt

SEQ ID NO: 2540 - DNA, 23 bp, Homo sapiens
tccattacactaccctgcctctt

SEQ ID NO: 2541 - DNA, 22 bp, Homo sapiens
tttggtccccttcaaccagcta

SEQ ID NO: 2542 - DNA, 18 bp, Homo sapiens
ctatacgacctgctgcct

SEQ ID NO: 2543 - DNA, 20 bp, Homo sapiens
ctggtacaggcctgggggac

SEQ ID NO: 2544 - DNA, 22 bp, Homo sapiens
ctctacagggaagcgctttctg

SEQ ID NO: 2545 - DNA, 20 bp, Homo sapiens
aagtgcttccatgttttagt

SEQ ID NO: 2546 - DNA, 21 bp, Homo sapiens
ccagcatcagtgattttgttg

SEQ ID NO: 2547 - DNA, 20 bp, Homo sapiens
tccattacactaccctgcct

SEQ ID NO: 2548 - DNA, 18 bp, Homo sapiens
tacaatgtagatttctgt

SEQ ID NO: 2549 - DNA, 21 bp, Homo sapiens
ctcccacacccaaggcttgca

SEQ ID NO: 2550 - DNA, 22 bp, Homo sapiens
tgtgttgcatgtgtgtatatgt

SEQ ID NO: 2551 - DNA, 19 bp, Homo sapiens
tggcactggtagaattcac

SEQ ID NO: 2552 - DNA, 25 bp, Homo sapiens
tgagaactgaattccataggctgtg

SEQ ID NO: 2553 - DNA, 20 bp, Homo sapiens
cacattgccagggattacca

SEQ ID NO: 2554 - DNA, 20 bp, Homo sapiens
ataccctgtagatccgaatt

SEQ ID NO: 2555 - DNA, 21 bp, Homo sapiens
aactagtaatgttggattagg

SEQ ID NO: 2556 - DNA, 21 bp, Homo sapiens
aaagtgcttccctttggactg

SEQ ID NO: 2557 - DNA, 20 bp, Homo sapiens
tagtggatgatgcactctgt

SEQ ID NO: 2558 - DNA, 19 bp, Homo sapiens
tcactcctctcctcccgtc

SEQ ID NO: 2559 - DNA, 17 bp, Homo sapiens
tgcactacagaactttg

SEQ ID NO: 2560 - DNA, 22 bp, Homo sapiens
ccttcattccaccggagtctgt

SEQ ID NO: 2561 - DNA, 21 bp, Homo sapiens
ttgcaacgaacctgagccact

SEQ ID NO: 2562 - DNA, 22 bp, Homo sapiens
cctctacagggaagcgctttct

SEQ ID NO: 2563 - DNA, 23 bp, Homo sapiens
gagaactgaattccataggctgt

SEQ ID NO: 2564 - DNA, 22 bp, Homo sapiens
ctgcaaagggaagccctttctg

SEQ ID NO: 2565 - DNA, 16 bp, Homo sapiens
aatggtagaactcaca

SEQ ID NO: 2566 - DNA, 21 bp, Homo sapiens
taattttatgtataagctagt

SEQ ID NO: 2567 - DNA, 19 bp, Homo sapiens
caaagtgcttacagtgcag

SEQ ID NO: 2568 - DNA, 19 bp, Homo sapiens
cactggtagaattcactgt

SEQ ID NO: 2569 - DNA, 23 bp, Homo sapiens
cacccgtcccgttcgtccccgga

SEQ ID NO: 2570 - DNA, 21 bp, Homo sapiens
tagcagcacatcatggtttac

SEQ ID NO: 2571 - DNA, 24 bp, Homo sapiens
ttctcgaggaaagaagcactttct

SEQ ID NO: 2572 - DNA, 19 bp, Homo sapiens
ggtagtaggttgtatggtt

SEQ ID NO: 2573 - DNA, 20 bp, Homo sapiens
cagtgcaatgatgaaagggc

SEQ ID NO: 2574 - DNA, 20 bp, Homo sapiens
attgcacttgtcccggcctg

SEQ ID NO: 2575 - DNA, 22 bp, Homo sapiens
tatacaatctactgtctttcct

SEQ ID NO: 2576 - DNA, 20 bp, Homo sapiens
ctgtttgcagaggaaactga

SEQ ID NO: 2577 - DNA, 20 bp, Homo sapiens
aatactgcctggtaatgatg

SEQ ID NO: 2578 - DNA, 22 bp, Homo sapiens
cagtccatgggcatatacactt

SEQ ID NO: 2579 - DNA, 22 bp, Homo sapiens
cctggactgagccgtgctactg

SEQ ID NO: 2580 - DNA, 20 bp, Homo sapiens
tccagttttcccaggaatcc

SEQ ID NO: 2581 - DNA, 21 bp, Homo sapiens
tcaaagtgcttacagtgcagg

SEQ ID NO: 2582 - DNA, 19 bp, Homo sapiens
ggctgtaccaccttgtcgg

SEQ ID NO: 2583 - DNA, 20 bp, Homo sapiens
agatgaagcactgtagctca

SEQ ID NO: 2584 - DNA, 23 bp, Homo sapiens
cagtgcactacagaactttgtct

SEQ ID NO: 2585 - DNA, 22 bp, Homo sapiens
caaagtgcttccctttagagtg

SEQ ID NO: 2586 - DNA, 17 bp, Homo sapiens
tgaggtaggaggttgta

SEQ ID NO: 2587 - DNA, 22 bp, Homo sapiens
atcgggaatgtcgtgtccgccc

SEQ ID NO: 2588 - DNA, 21 bp, Homo sapiens
ctacaaagggaagcactttct

SEQ ID NO: 2589 - DNA, 22 bp, Homo sapiens
atatacaagggcaagctctctg

SEQ ID NO: 2590 - DNA, 22 bp, Homo sapiens
aaagtgctgcgacatttgagcg

SEQ ID NO: 2591 - DNA, 24 bp, Homo sapiens
taaacgtggatgtacttgctttga

SEQ ID NO: 2592 - DNA, 20 bp, Homo sapiens
taaacgtggatgtacttgct

SEQ ID NO: 2593 - DNA, 19 bp, Homo sapiens
actcaaactgtgggggcac

SEQ ID NO: 2594 - DNA, 22 bp, Homo sapiens
actcaaaatgggggcgctttcc

SEQ ID NO: 2595 - DNA, 22 bp, Homo sapiens
gaagtgcttcgattttggggtg

SEQ ID NO: 2596 - DNA, 21 bp, Homo sapiens
tcgtacagggtcatccacttt

SEQ ID NO: 2597 - DNA, 21 bp, Homo sapiens
aagtgctgtcatagctgaggt

SEQ ID NO: 2598 - DNA, 22 bp, Homo sapiens
aacaaacatggtgcacttcttt

SEQ ID NO: 2599 - DNA, 22 bp, Homo sapiens
accgtggctttcgattgttact

SEQ ID NO: 2600 - DNA, 21 bp, Homo sapiens
aatcatacacggttgacctat

SEQ ID NO: 2601 - DNA, 21 bp, Homo sapiens
ttggttatctagctgtatgag

SEQ ID NO: 2602 - DNA, 22 bp, Homo sapiens
tggcagtgtcttagctggttgt

SEQ ID NO: 2603 - DNA, 23 bp, Homo sapiens
atatacaagggcaagctctctgt

SEQ ID NO: 2604 - DNA, 20 bp, Homo sapiens
tggagacgcggccctgttgg

SEQ ID NO: 2605 - DNA, 19 bp, Homo sapiens
tggtagactatggaacgta

SEQ ID NO: 2606 - DNA, 22 bp, Homo sapiens
aagtgcttcgattttggggtgt

SEQ ID NO: 2607 - DNA, 21 bp, Homo sapiens
aatcattcacggacaacactt

SEQ ID NO: 2608 - DNA, 20 bp, Homo sapiens
aagctgccagttgaagaact

SEQ ID NO: 2609 - DNA, 24 bp, Homo sapiens
gaatgttgctcggtgaaccccttt

SEQ ID NO: 2610 - DNA, 22 bp, Homo sapiens
tgagaactgaattccataggct

SEQ ID NO: 2611 - DNA, 22 bp, Homo sapiens
atcacacaaaggcaacttttgt

SEQ ID NO: 2612 - DNA, 21 bp, Homo sapiens
taggttatccgtgttgccttc

SEQ ID NO: 2613 - DNA, 22 bp, Homo sapiens
atcacattgccagggattacca

SEQ ID NO: 2614 - DNA, 22 bp, Homo sapiens
caaaacgtgaggcgctgctata

SEQ ID NO: 2615 - DNA, 24 bp, Homo sapiens
ttcaccaccttctccacccagcat

SEQ ID NO: 2616 - DNA, 21 bp, Homo sapiens
aaacaaacatggtgcacttct

SEQ ID NO: 2617 - DNA, 21 bp, Homo sapiens
atggtagactatggaacgtag

SEQ ID NO: 2618 - DNA, 21 bp, Homo sapiens
tcgaccggacctcgaccggct

SEQ ID NO: 2619 - DNA, 21 bp, Homo sapiens
tcagtgcatgacagaacttgg

SEQ ID NO: 2620 - DNA, 22 bp, Homo sapiens
ttaaggcacgcggtgaatgcca

SEQ ID NO: 2621 - DNA, 21 bp, Homo sapiens
agtgccgccatcttttgagtg

SEQ ID NO: 2622 - DNA, 25 bp, Homo sapiens
tgtaaacatccccgactggaagctg

SEQ ID NO: 2623 - DNA, 22 bp, Homo sapiens
tggtgggcacagaatctggact

SEQ ID NO: 2624 - DNA, 21 bp, Homo sapiens
tgagtattacatggccaatct

SEQ ID NO: 2625 - DNA, 21 bp, Homo sapiens
caacaccagtcgatgggctgt

SEQ ID NO: 2626 - DNA, 24 bp, Homo sapiens
caggtcacgtctctgcagttacac

SEQ ID NO: 2627 - DNA, 22 bp, Homo sapiens
ctagactgaagctccttgagga

SEQ ID NO: 2628 - DNA, 20 bp, Homo sapiens
agatcgaccgtgttatattc

SEQ ID NO: 2629 - DNA, 21 bp, Homo sapiens
atgctgacatatttactagag

SEQ ID NO: 2630 - DNA, 20 bp, Homo sapiens
tagtagaccgtatagcgtac

SEQ ID NO: 2631 - DNA, 22 bp, Homo sapiens
ctgctcataccccatggtttct

SEQ ID NO: 2632 - DNA, 21 bp, Homo sapiens
ctctacagggaagcgctttct

SEQ ID NO: 2633 - DNA, 21 bp, Homo sapiens
atatgtctgctgaccatcacc

SEQ ID NO: 2634 - DNA, 22 bp, Homo sapiens
tacgtagatatatatgtatttt

SEQ ID NO: 2635 - DNA, 25 bp, Homo sapiens
tgcaccatggttgtctgagcatgca

SEQ ID NO: 2636 - DNA, 23 bp, Homo sapiens
ctcctatatgatgcctttcttca

SEQ ID NO: 2637 - DNA, 22 bp, Homo sapiens
tggagagaaaggcagttcctga

SEQ ID NO: 2638 - DNA, 22 bp, Homo sapiens
tctgctcataccccatggtttc

SEQ ID NO: 2639 - DNA, 23 bp, Homo sapiens
tagcagcacatcatggtttacat

SEQ ID NO: 2640 - DNA, 20 bp, Homo sapiens
ttttgcaccttttggagtga

SEQ ID NO: 2641 - DNA, 23 bp, Homo sapiens
aaacattcgcggtgcacttcttt

SEQ ID NO: 2642 - DNA, 21 bp, Homo sapiens
tctgctcataccccatggttt

SEQ ID NO: 2643 - DNA, 22 bp, Homo sapiens
tgtcttactccctcaggcacat

SEQ ID NO: 2644 - DNA, 22 bp, Homo sapiens
aagtgcttccatgtttcagtgg

SEQ ID NO: 2645 - DNA, 21 bp, Homo sapiens
gaatgttgctcggtgaacccc

SEQ ID NO: 2646 - DNA, 21 bp, Homo sapiens
ttcaagtaattcaggataggt

SEQ ID NO: 2647 - DNA, 23 bp, Homo sapiens
agatcgaccgtgttatattcgct

SEQ ID NO: 2648 - DNA, 20 bp, Homo sapiens
tagcttatcagactgatgtt

SEQ ID NO: 2649 - DNA, 22 bp, Homo sapiens
cttagcaggttgtattatcatt

SEQ ID NO: 2650 - DNA, 22 bp, Homo sapiens
aaagtgcttccttttagagggt

SEQ ID NO: 2651 - DNA, 22 bp, Homo sapiens
aatataacacagatggcctgtt

SEQ ID NO: 2652 - DNA, 23 bp, Homo sapiens
tcggggatcatcatgtcacgaga

SEQ ID NO: 2653 - DNA, 20 bp, Homo sapiens
ctgatgtttgacccttgagc

SEQ ID NO: 2654 - DNA, 22 bp, Homo sapiens
atcaacagacattaattgggcg

SEQ ID NO: 2655 - DNA, 21 bp, Homo sapiens
tggtgggccgcagaacatgtg

SEQ ID NO: 2656 - DNA, 20 bp, Homo sapiens
taagtgcttccatgtttcag

SEQ ID NO: 2657 - DNA, 23 bp, Homo sapiens
atcaacagacattaattgggcgc

SEQ ID NO: 2658 - DNA, 23 bp, Homo sapiens
ggattcctggaaatactgttctt

SEQ ID NO: 2659 - DNA, 22 bp, Homo sapiens
tttaacatgggggtacctgctg

SEQ ID NO: 2660 - DNA, 21 bp, Homo sapiens
tgtcttgcaggccgtcatgca

SEQ ID NO: 2661 - DNA, 22 bp, Homo sapiens
ttcacaaggaggtgtcatttat

SEQ ID NO: 2662 - DNA, 21 bp, Homo sapiens
gaagttgttcgtggtggattc

SEQ ID NO: 2663 - DNA, 22 bp, Homo sapiens
gacacgatcactcccgttgagt

SEQ ID NO: 2664 - DNA, 24 bp, Homo sapiens
ctctggagggaagcactttctgtt

SEQ ID NO: 2665 - DNA, 19 bp, Homo sapiens
tcctatatgatgcctttct

SEQ ID NO: 2666 - DNA, 20 bp, Homo sapiens
ttgacacttctgtgagtaga

SEQ ID NO: 2667 - DNA, 18 bp, Homo sapiens
tgagatgaagcactgtag

SEQ ID NO: 2668 - DNA, 22 bp, Homo sapiens
catctgggcaactgactgaact

SEQ ID NO: 2669 - DNA, 23 bp, Homo sapiens
actttaacatggaagtgctttct

SEQ ID NO: 2670 - DNA, 23 bp, Homo sapiens
tactgcagacagtggcaatcatg

SEQ ID NO: 2671 - DNA, 21 bp, Homo sapiens
taaagtgctgacagtgcagat

SEQ ID NO: 2672 - DNA, 22 bp, Homo sapiens
gttgaggtagtaggttgtatgg

SEQ ID NO: 2673 - DNA, 22 bp, Homo sapiens
actcagccttgagggcactttc

SEQ ID NO: 2674 - DNA, 22 bp, Homo sapiens
tcaaaactgaggggcattttct

SEQ ID NO: 2675 - DNA, 23 bp, Homo sapiens
caaatgctcagactcctgtggtg

SEQ ID NO: 2676 - DNA, 20 bp, Homo sapiens
gcctgctggggtggaacctg

SEQ ID NO: 2677 - DNA, 19 bp, Homo sapiens
gtcagtttgtcaaataccc

SEQ ID NO: 2678 - DNA, 23 bp, Homo sapiens
tgagaactgaattccataggctg

SEQ ID NO: 2679 - DNA, 21 bp, Homo sapiens
aaagtgcttcctttttgaggg

SEQ ID NO: 2680 - DNA, 22 bp, Homo sapiens
tccctgagaccctttaacctgt

SEQ ID NO: 2681 - DNA, 22 bp, Homo sapiens
ctcgtgtcttgtgttgcagccg

SEQ ID NO: 2682 - DNA, 21 bp, Homo sapiens
aatgcacccgggcaaggattc

SEQ ID NO: 2683 - DNA, 21 bp, Homo sapiens
ctcttgagggaagcactttct

SEQ ID NO: 2684 - DNA, 22 bp, Homo sapiens
ccacggatgtttgagcatgtgc

SEQ ID NO: 2685 - DNA, 22 bp, Homo sapiens
agatcagaaggtgattgtggct

SEQ ID NO: 2686 - DNA, 23 bp, Homo sapiens
taaagtgcttatagtgcaggtag

SEQ ID NO: 2687 - DNA, 21 bp, Homo sapiens
ctctgaaattcagttcttcag

SEQ ID NO: 2688 - DNA, 23 bp, Homo sapiens
ttagggccctggctccatctcct

SEQ ID NO: 2689 - DNA, 23 bp, Homo sapiens
cccagtgttcagactacctgttc

SEQ ID NO: 2690 - DNA, 22 bp, Homo sapiens
aacgcgcttccctatagagggt

SEQ ID NO: 2691 - DNA, 20 bp, Homo sapiens
ttttctgtggtacttgaaga

SEQ ID NO: 2692 - DNA, 22 bp, Homo sapiens
tgtaaggcacccttctgagtag

SEQ ID NO: 2693 - DNA, 20 bp, Homo sapiens
ctacagtatagatgatgtac

SEQ ID NO: 2694 - DNA, 23 bp, Homo sapiens
tattgcactcgtcccggcctccg

SEQ ID NO: 2695 - DNA, 19 bp, Homo sapiens
tggagacgcggccctgttg

SEQ ID NO: 2696 - DNA, 22 bp, Homo sapiens
ttcattcggctgtccagatgta

SEQ ID NO: 2697 - DNA, 22 bp, Homo sapiens
atctggaggtaagaagcacttt

SEQ ID NO: 2698 - DNA, 23 bp, Homo sapiens
actttaacatggaggcacttgct

SEQ ID NO: 2699 - DNA, 23 bp, Homo sapiens
aatcctttgtccctgggtgagag

SEQ ID NO: 2700 - DNA, 23 bp, Homo sapiens
ccaatattggctgtgctgctcca

SEQ ID NO: 2701 - DNA, 22 bp, Homo sapiens
ctcaaactgtgggggcactttc

SEQ ID NO: 2702 - DNA, 23 bp, Homo sapiens
ctgtacaaccttctagctttcct

SEQ ID NO: 2703 - DNA, 20 bp, Homo sapiens
tggtttaccgtcccacatac

SEQ ID NO: 2704 - DNA, 24 bp, Homo sapiens
gttgaggtagtaggttgtatggtt

SEQ ID NO: 2705 - DNA, 21 bp, Homo sapiens
gaccctggtctgcactctatc

SEQ ID NO: 2706 - DNA, 18 bp, Homo sapiens
tgattgtagccttttgga

SEQ ID NO: 2707 - DNA, 22 bp, Homo sapiens
tacccagagcatgcagtgtgaa

SEQ ID NO: 2708 - DNA, 22 bp, Homo sapiens
aaagtgcatctttttagaggat

SEQ ID NO: 2709 - DNA, 22 bp, Homo sapiens
gaaagcgcttccctttgctgga

SEQ ID NO: 2710 - DNA, 19 bp, Homo sapiens
tgattgtccaaacgcaatt

SEQ ID NO: 2711 - DNA, 23 bp, Homo sapiens
aaagtgcatctttttagaggatt

SEQ ID NO: 2712 - DNA, 22 bp, Homo sapiens
aaagtgcttcctttttgagggt

SEQ ID NO: 2713 - DNA, 21 bp, Homo sapiens
tatgtaacatggtccactaac

SEQ ID NO: 2714 - DNA, 20 bp, Homo sapiens
agtgtttcctactttatgga

SEQ ID NO: 2715 - DNA, 22 bp, Homo sapiens
actttaacatggaggcacttgc

SEQ ID NO: 2716 - DNA, 21 bp, Homo sapiens
gctgcgcttggatttcgtccc

SEQ ID NO: 2717 - DNA, 19 bp, Homo sapiens
ctacagtatagatgatgta

SEQ ID NO: 2718 - DNA, 22 bp, Homo sapiens
tgattgtccaaacgcaattctt

SEQ ID NO: 2719 - DNA, 20 bp, Homo sapiens
agaagatctcaggctgtgtc

SEQ ID NO: 2720 - DNA, 19 bp, Homo sapiens
gaagatctcaggctgtgac

SEQ ID NO: 2721 - DNA, 21 bp, Homo sapiens
agtgcttccatgtttgagtgt

SEQ ID NO: 2722 - DNA, 21 bp, Homo sapiens
cgaatgttgctcggtgaaccc

SEQ ID NO: 2723 - DNA, 20 bp, Homo sapiens
agtcagtagttggggggtgg

SEQ ID NO: 2724 - DNA, 23 bp, Homo sapiens
atctggaggtaagaagcactttc

SEQ ID NO: 2725 - DNA, 24 bp, Homo sapiens
atctggaggtaagaagcactttct

SEQ ID NO: 2726 - DNA, 21 bp, Homo sapiens
aagtgcttccatgttttggtg

SEQ ID NO: 2727 - DNA, 20 bp, Homo sapiens
gtgttggatgagccctcgga

SEQ ID NO: 2728 - DNA, 22 bp, Homo sapiens
cgtgtatttgacaagctgagtt

SEQ ID NO: 2729 - DNA, 20 bp, Homo sapiens
gcgacccactcttggtttcc

SEQ ID NO: 2730 - DNA, 21 bp, Homo sapiens
tcagtgcatcacagaactttg

SEQ ID NO: 2731 - DNA, 21 bp, Homo sapiens
tcacaagtcaggctcttggga

SEQ ID NO: 2732 - DNA, 22 bp, Homo sapiens
taacagtctccagtcacggcca

SEQ ID NO: 2733 - DNA, 21 bp, Homo sapiens
ccctctagatggaagcactgt

SEQ ID NO: 2734 - DNA, 19 bp, Homo sapiens
tttgtgacctggtccacta

SEQ ID NO: 2735 - DNA, 19 bp, Homo sapiens
tatgtctgctgaccatcac

SEQ ID NO: 2736 - DNA, 18 bp, Homo sapiens
tgtgactggttgaccaga

SEQ ID NO: 2737 - DNA, 21 bp, Homo sapiens
ttcattcggctgtccagatgt

SEQ ID NO: 2738 - DNA, 23 bp, Homo sapiens
aatcactaaccacacggccaggt

SEQ ID NO: 2739 - DNA, 21 bp, Homo sapiens
attgcactttagcaatggtga

SEQ ID NO: 2740 - DNA, 20 bp, Homo sapiens
aagaggtatagggcatggga

SEQ ID NO: 2741 - DNA, 21 bp, Homo sapiens
tatgtaatatggtccacatct

SEQ ID NO: 2742 - DNA, 21 bp, Homo sapiens
catctgggcaactgactgaac

SEQ ID NO: 2743 - DNA, 21 bp, Homo sapiens
ctagcaccatctgaaatcggt

SEQ ID NO: 2744 - DNA, 19 bp, Homo sapiens
tttctgtggtacttgaaga

SEQ ID NO: 2745 - DNA, 20 bp, Homo sapiens
aagcccttaccccaaaaagc

SEQ ID NO: 2746 - DNA, 20 bp, Homo sapiens
tgtcttgcaggccgtcatgc

SEQ ID NO: 2747 - DNA, 23 bp, Homo sapiens
cttatcagattgtattgtaattg

SEQ ID NO: 2748 - DNA, 21 bp, Homo sapiens
ctctggagggaagcactttct

SEQ ID NO: 2749 - DNA, 21 bp, Homo sapiens
ctgcgcttggatttcgtcccc

SEQ ID NO: 2750 - DNA, 21 bp, Homo sapiens
ctcaaactgtgggggcacttt

SEQ ID NO: 2751 - DNA, 24 bp, Homo sapiens
ttatcagactgatgttgactgttg

SEQ ID NO: 2752 - DNA, 23 bp, Homo sapiens
cttcaccaccttctccacccagc

SEQ ID NO: 2753 - DNA, 20 bp, Homo sapiens
cagtggttttaccctatggt

SEQ ID NO: 2754 - DNA, 19 bp, Homo sapiens
agaggtatagggcatggga

SEQ ID NO: 2755 - DNA, 21 bp, Homo sapiens
aagctgccagttgaagaactg

SEQ ID NO: 2756 - DNA, 22 bp, Homo sapiens
cccccaggtgtgattctgattt

SEQ ID NO: 2757 - DNA, 20 bp, Homo sapiens
ctctgaaattcagttcttca

SEQ ID NO: 2758 - DNA, 23 bp, Homo sapiens
tttaacatgggggtacctgctgt

SEQ ID NO: 2759 - DNA, 22 bp, Homo sapiens
aaagtgcttctctttggtgggt

SEQ ID NO: 2760 - DNA, 19 bp, Homo sapiens
gaatgttgctcggtgaacc

SEQ ID NO: 2761 - DNA, 19 bp, Homo sapiens
acccgtagatccgaacttg

SEQ ID NO: 2762 - DNA, 22 bp, Homo sapiens
caatcactaactccactgccat

SEQ ID NO: 2763 - DNA, 25 bp, Homo sapiens
tgtaaacatccttgactggaagctg

SEQ ID NO: 2764 - DNA, 20 bp, Homo sapiens
gctacatctggctactgggt

SEQ ID NO: 2765 - DNA, 21 bp, Homo sapiens
catatgtctgctgaccatcac

SEQ ID NO: 2766 - DNA, 21 bp, Homo sapiens
aggttgtctgtgatgagttcg

SEQ ID NO: 2767 - DNA, 20 bp, Homo sapiens
agtgcttatagtgcaggtag

SEQ ID NO: 2768 - DNA, 22 bp, Homo sapiens
acttatcagattgtattgtaat

SEQ ID NO: 2769 - DNA, 22 bp, Homo sapiens
aataatacatggttgatctttt

SEQ ID NO: 2770 - DNA, 20 bp, Homo sapiens
gagaactgaattccatgggt

SEQ ID NO: 2771 - DNA, 23 bp, Homo sapiens
taggcagtgtagttagctgattg

SEQ ID NO: 2772 - DNA, 22 bp, Homo sapiens
gctctgacgaggttgcactact

SEQ ID NO: 2773 - DNA, 22 bp, Homo sapiens
taggcagtgtagttagctgatt

SEQ ID NO: 2774 - DNA, 23 bp, Homo sapiens
gtaaacatccttgactggaagct

SEQ ID NO: 2775 - DNA, 18 bp, Homo sapiens
ttctgtggtacttgaaga

SEQ ID NO: 2776 - DNA, 18 bp, Homo sapiens
tcggatccgtctgagctt

SEQ ID NO: 2777 - DNA, 20 bp, Homo sapiens
tactctggagagtgacaatc

SEQ ID NO: 2778 - DNA, 24 bp, Homo sapiens
tgtaaacatccttgactggaagct

SEQ ID NO: 2779 - DNA, 23 bp, Homo sapiens
ctctacagggaagcgctttctgt

SEQ ID NO: 2780 - DNA, 20 bp, Homo sapiens
aatgctcagactcctgtggt

SEQ ID NO: 2781 - DNA, 22 bp, Homo sapiens
gtaaacatccttgactggaagc

SEQ ID NO: 2782 - DNA, 23 bp, Homo sapiens
tgaccgatttctcctggtgttca

SEQ ID NO: 2783 - DNA, 22 bp, Homo sapiens
tcgtacagggtcatccactttt

SEQ ID NO: 2784 - DNA, 20 bp, Homo sapiens
agtgctcatagtgcaggtag

SEQ ID NO: 2785 - DNA, 24 bp, Homo sapiens
caatcactaactccactgccatca

SEQ ID NO: 2786 - DNA, 22 bp, Homo sapiens
atcactaactccactgccatca

SEQ ID NO: 2787 - DNA, 20 bp, Homo sapiens
ttgtacatggtaggctttca

SEQ ID NO: 2788 - DNA, 22 bp, Homo sapiens
ctccagagggaagtactttctg

SEQ ID NO: 2789 - DNA, 24 bp, Homo sapiens
cagatcagaaggtgattgtggctt

SEQ ID NO: 2790 - DNA, 22 bp, Homo sapiens
attcctggaaatactgttcttg

SEQ ID NO: 2791 - DNA, 22 bp, Homo sapiens
ctctggagggaagcactttctg

SEQ ID NO: 2792 - DNA, 21 bp, Homo sapiens
tgtaaacatccccgactggaa

SEQ ID NO: 2793 - DNA, 19 bp, Homo sapiens
taacagtctacagccatgg

SEQ ID NO: 2794 - DNA, 20 bp, Homo sapiens
tcttcatgtgactcgtggac

SEQ ID NO: 2795 - DNA, 22 bp, Homo sapiens
gctttaacatgggggtacctgc

SEQ ID NO: 2796 - DNA, 23 bp, Homo sapiens
caaagtgcttccctttagagtgt

SEQ ID NO: 2797 - DNA, 22 bp, Homo sapiens
aggtcctcaataagtatttgtt

SEQ ID NO: 2798 - DNA, 21 bp, Homo sapiens
atcacattgccagggattacc

SEQ ID NO: 2799 - DNA, 24 bp, Homo sapiens
aattgcacggtatccatctgtaaa

SEQ ID NO: 2800 - DNA, 21 bp, Homo sapiens
tacccagagcatgcagtgtga

SEQ ID NO: 2801 - DNA, 22 bp, Homo sapiens
ctggctagggaaaatgattgga

SEQ ID NO: 2802 - DNA, 22 bp, Homo sapiens
cttggcacctagcaagcactca

SEQ ID NO: 2803 - DNA, 20 bp, Homo sapiens
ctgtacagcctcctagcttt

SEQ ID NO: 2804 - DNA, 20 bp, Homo sapiens
ttcattcggctgtccagatg

SEQ ID NO: 2805 - DNA, 21 bp, Homo sapiens
caatcactaactccactgcca

SEQ ID NO: 2806 - DNA, 21 bp, Homo sapiens
tgagtaccgccatgtctgttg

SEQ ID NO: 2807 - DNA, 20 bp, Homo sapiens
ctccagagggaagtactttc

SEQ ID NO: 2808 - DNA, 23 bp, Homo sapiens
aatcactaactccactgccatca

SEQ ID NO: 2809 - DNA, 22 bp, Homo sapiens
ctcattgcatgggctgtgtata

SEQ ID NO: 2810 - DNA, 23 bp, Homo sapiens
ttcattcggctgtccagatgtat

SEQ ID NO: 2811 - DNA, 19 bp, Homo sapiens
ttcattcggctgtccagat

SEQ ID NO: 2812 - DNA, 21 bp, Homo sapiens
ctcattgcatgggctgtgtat

SEQ ID NO: 2813 - DNA, 22 bp, Homo sapiens
aagcccttaccccaaaaagtat

SEQ ID NO: 2814 - DNA, 22 bp, Homo sapiens
caagtcttatttgagcacctgt

SEQ ID NO: 2815 - DNA, 21 bp, Homo sapiens
aggtcctcaataagtatttgt

SEQ ID NO: 2816 - DNA, 22 bp, Homo sapiens
caccaggcattgtggtctccgc

SEQ ID NO: 2817 - DNA, 22 bp, Homo sapiens
tcattgcatgggctgtgtatag

SEQ ID NO: 2818 - DNA, 21 bp, Homo sapiens
ttgcatatgtaggatgtccca

SEQ ID NO: 2819 - DNA, 21 bp, Homo sapiens
agtaagtgcttccatgttttg

SEQ ID NO: 2820 - DNA, 22 bp, Homo sapiens
acaaagtgcttccctttagagt

SEQ ID NO: 2821 - DNA, 21 bp, Homo sapiens
agaactgaattccatgggttg

SEQ ID NO: 2822 - DNA, 23 bp, Homo sapiens
gtgaacgggcgccatcccgaggc

SEQ ID NO: 2823 - DNA, 23 bp, Homo sapiens
tacatctgggcaactgactgaac

SEQ ID NO: 2824 - DNA, 23 bp, Homo sapiens
catctgggcaactgactgaactt

SEQ ID NO: 2825 - DNA, 22 bp, Homo sapiens
atatagggattggagccgtggc

SEQ ID NO: 2826 - DNA, 22 bp, Homo sapiens
ttgcatatgtaggatgtcccat

SEQ ID NO: 2827 - DNA, 22 bp, Homo sapiens
gaacatcctgcatagtgctgcc

SEQ ID NO: 2828 - DNA, 24 bp, Homo sapiens
tacccattgcatatcggagttgtg

SEQ ID NO: 2829 - DNA, 22 bp, Homo sapiens
agtggggaacccttccatgagg

SEQ ID NO: 2830 - DNA, 22 bp, Homo sapiens
aattgcactttagcaatggtga

SEQ ID NO: 2831 - DNA, 23 bp, Homo sapiens
taggcagtgtcattagctgattg

SEQ ID NO: 2832 - DNA, 21 bp, Homo sapiens
atcgggaatgtcgtgtccgcc

SEQ ID NO: 2833 - DNA, 18 bp, Homo sapiens
ttcattcggctgtccaga

SEQ ID NO: 2834 - DNA, 20 bp, Homo sapiens
ctcattgcatgggctgtgta

SEQ ID NO: 2835 - DNA, 17 bp, Homo sapiens
ttcattcggctgtccag

SEQ ID NO: 2836 - DNA, 20 bp, Homo sapiens
catctgggcaactgactgaa

SEQ ID NO: 2837 - DNA, 19 bp, Homo sapiens
catctgggcaactgactga

SEQ ID NO: 2838 - DNA, 22 bp, Homo sapiens
ggctgggaaggcaaagggacgt

SEQ ID NO: 2839 - DNA, 23 bp, Homo sapiens
atcactaaccacacggccaggta

SEQ ID NO: 2840 - DNA, 22 bp, Homo sapiens
tgtaacagcaactccatgtgga

SEQ ID NO: 2841 - DNA, 22 bp, Homo sapiens
taggcagtgtcattagctgatt

SEQ ID NO: 2842 - DNA, 23 bp, Homo sapiens
tgattgtccaaacgcaattctcg

SEQ ID NO: 2843 - DNA, 21 bp, Homo sapiens
ctgctcataccccatggtttc

SEQ ID NO: 2844 - DNA, 21 bp, Homo sapiens
tggctcagttcagcaggaaca

SEQ ID NO: 2845 - DNA, 20 bp, Homo sapiens
ctcttgagggaagcactttc

SEQ ID NO: 2846 - DNA, 22 bp, Homo sapiens
actggctagggaaaatgattgg

SEQ ID NO: 2847 - DNA, 21 bp, Homo sapiens
ctgacgtgcggtacttaatga

SEQ ID NO: 2848 - DNA, 22 bp, Homo sapiens
atacccagagcatgcagtgtga

SEQ ID NO: 2849 - DNA, 22 bp, Homo sapiens
cccagagcatgcagtgtgaaca

SEQ ID NO: 2850 - DNA, 21 bp, Homo sapiens
tcattgcatgggctgtgtata

SEQ ID NO: 2851 - DNA, 23 bp, Homo sapiens
tcattgcatgggctgtgtatagt

SEQ ID NO: 2852 - DNA, 24 bp, Homo sapiens
ctcattgcatgggctgtgtatagt

SEQ ID NO: 2853 - DNA, 23 bp, Homo sapiens
caccaggcattgtggtctccgct

SEQ ID NO: 2854 - DNA, 21 bp, Homo sapiens
ggtcctcaataagtatttgtt

SEQ ID NO: 2855 - DNA, 23 bp, Homo sapiens
ggtgctcacttgtcctcctccat

SEQ ID NO: 2856 - DNA, 23 bp, Homo sapiens
acaagtcttatttgagcacctgt

SEQ ID NO: 2857 - DNA, 23 bp, Homo sapiens
cttccctttgtcatcctatgcct

SEQ ID NO: 2858 - DNA, 23 bp, Homo sapiens
atacccagagcatgcagtgtgaa

SEQ ID NO: 2859 - DNA, 21 bp, Homo sapiens
tacatctgggcaactgactga

SEQ ID NO: 2860 - DNA, 23 bp, Homo sapiens
gaacatcctgcatagtgctgcca

SEQ ID NO: 2861 - DNA, 21 bp, Homo sapiens
gaacatcctgcatagtgctgc

SEQ ID NO: 2862 - DNA, 23 bp, Homo sapiens
tacccagagcatgcagtgtgaac

SEQ ID NO: 2863 - DNA, 24 bp, Homo sapiens
ttcattcggctgtccagatgtatc

SEQ ID NO: 2864 - DNA, 24 bp, Homo sapiens
catctgggcaactgactgaacttt

SEQ ID NO: 2865 - DNA, 24 bp, Homo sapiens
tgaggtagtaggttgtgtggtttc

SEQ ID NO: 2866 - DNA, 22 bp, Homo sapiens
tattgcacattactaagttgca

SEQ ID NO: 2867 - DNA, 21 bp, Homo sapiens
ctagcaccatttgaaatcggt

SEQ ID NO: 2868 - DNA, 23 bp, Homo sapiens
tgcctgctggggtggaacctggt

SEQ ID NO: 2869 - DNA, 21 bp, Homo sapiens
accactgaccgttgactgtac

SEQ ID NO: 2870 - DNA, 22 bp, Homo sapiens
atgaggtagtaggttgtatagt

SEQ ID NO: 2871 - DNA, 23 bp, Homo sapiens
ccacccgtagaaccgaccttgcg

SEQ ID NO: 2872 - DNA, 23 bp, Homo sapiens
gttcacagtggctaagttctgca

SEQ ID NO: 2873 - DNA, 17 bp, Homo sapiens
gctagataaccgaaagt

SEQ ID NO: 2874 - DNA, 22 bp, Homo sapiens
tgtgtgactggttgaccagagg

SEQ ID NO: 2875 - DNA, 20 bp, Homo sapiens
cctctagatggaagcactgt

SEQ ID NO: 2876 - DNA, 22 bp, Homo sapiens
atcctgtactgagctgccccga

SEQ ID NO: 2877 - DNA, 23 bp, Homo sapiens
tctttggttatctagctgtatga

SEQ ID NO: 2878 - DNA, 23 bp, Homo sapiens
ggtccagttttcccaggaatccc

SEQ ID NO: 2879 - DNA, 23 bp, Homo sapiens
ccactagattgtgagctcctgga

SEQ ID NO: 2880 - DNA, 20 bp, Homo sapiens
atgctgacatatttactaga

SEQ ID NO: 2881 - DNA, 21 bp, Homo sapiens
atgcacccgggcaaggattct

SEQ ID NO: 2882 - DNA, 20 bp, Homo sapiens
ttggtacgtctgtgggtaga

SEQ ID NO: 2883 - DNA, 23 bp, Homo sapiens
ccatgccttgagtgtaggaccgt

SEQ ID NO: 2884 - DNA, 20 bp, Homo sapiens
ccatcgaccgttgattgtac

SEQ ID NO: 2885 - DNA, 23 bp, Homo sapiens
gtagaggagatggcgcaggggac

SEQ ID NO: 2886 - DNA, 23 bp, Homo sapiens
caaagcgctcccctttagaggtt

SEQ ID NO: 2887 - DNA, 21 bp, Homo sapiens
cagtccatgggcatatacact

SEQ ID NO: 2888 - DNA, 21 bp, Homo sapiens
aatcctttgtccctgggtgag

SEQ ID NO: 2889 - DNA, 21 bp, Homo sapiens
gtggatattccttctatgttt

SEQ ID NO: 2890 - DNA, 19 bp, Homo sapiens
aacgaacctgagccactga

SEQ ID NO: 2891 - DNA, 21 bp, Homo sapiens
atgtagggctaaaagccatgg

SEQ ID NO: 2892 - DNA, 23 bp, Homo sapiens
ttctccaaaagaaagcactttct

SEQ ID NO: 2893 - DNA, 23 bp, Homo sapiens
tacagtactgtgataactgaagg

SEQ ID NO: 2894 - DNA, 20 bp, Homo sapiens
tggctcagttcagcaggaac

SEQ ID NO: 2895 - DNA, 23 bp, Homo sapiens
atcacattgccagggattaccac

SEQ ID NO: 2896 - DNA, 23 bp, Homo sapiens
atgagtgtactgtgggcttcgga

SEQ ID NO: 2897 - DNA, 23 bp, Homo sapiens
atattgcactcgtcccggcctcc

SEQ ID NO: 2898 - DNA, 23 bp, Homo sapiens
gctttcagtcggatgtttacagc

SEQ ID NO: 2899 - DNA, 21 bp, Homo sapiens
aaagcgcttcccttcagagtg

SEQ ID NO: 2900 - DNA, 26 bp, Homo sapiens
catgatactgtaaacgctttctgatg

SEQ ID NO: 2901 - DNA, 22 bp, Homo sapiens
tggtttcacatggtggcttaga

SEQ ID NO: 2902 - DNA, 20 bp, Homo sapiens
aaagtgcttccctttggact

SEQ ID NO: 2903 - DNA, 22 bp, Homo sapiens
tcctatatgatgcctttcttca

SEQ ID NO: 2904 - DNA, 20 bp, Homo sapiens
ccatggatctccaggtgggt

SEQ ID NO: 2905 - DNA, 18 bp, Homo sapiens
tacagtactgtgataact

SEQ ID NO: 2906 - DNA, 17 bp, Homo sapiens
ttgtgcttgatctaacc

SEQ ID NO: 2907 - DNA, 22 bp, Homo sapiens
ggggtattgtttccgctgccag

SEQ ID NO: 2908 - DNA, 22 bp, Homo sapiens
caaagcgcttctctttagagtg

SEQ ID NO: 2909 - DNA, 20 bp, Homo sapiens
caagatctcaggctgtgacc

SEQ ID NO: 2910 - DNA, 21 bp, Homo sapiens
gaagctcagagggctctgatt

SEQ ID NO: 2911 - DNA, 21 bp, Homo sapiens
tattcatttatccccagccta

SEQ ID NO: 2912 - DNA, 22 bp, Homo sapiens
attcatttatccccagcctaca

SEQ ID NO: 2913 - DNA, 23 bp, Homo sapiens
ctccagagggaagcgctttctgt

SEQ ID NO: 2914 - DNA, 22 bp, Homo sapiens
ctccagcatcagtgattttgtt

SEQ ID NO: 2915 - DNA, 20 bp, Homo sapiens
gctgactcctagtccagggc

SEQ ID NO: 2916 - DNA, 22 bp, Homo sapiens
atggtgggccgcagaacatgtg

SEQ ID NO: 2917 - DNA, 21 bp, Homo sapiens
cctggactgagccgtgctact

SEQ ID NO: 2918 - DNA, 22 bp, Homo sapiens
tgccctggcccgagggaccgac

SEQ ID NO: 2919 - DNA, 25 bp, Homo sapiens
gtccagttttcccaggaatccctta

SEQ ID NO: 2920 - DNA, 22 bp, Homo sapiens
gaagttgcccatgttattttcg

SEQ ID NO: 2921 - DNA, 19 bp, Homo sapiens
ttgtagccttttggagtag

SEQ ID NO: 2922 - DNA, 20 bp, Homo sapiens
aaatctctgcaggcaaatgt

SEQ ID NO: 2923 - DNA, 24 bp, Homo sapiens
ttatggtttgcctgggactgagga

SEQ ID NO: 2924 - DNA, 22 bp, Homo sapiens
gaaagcgcttctctttagagga

SEQ ID NO: 2925 - DNA, 21 bp, Homo sapiens
caaagcgcttctctttagagt

SEQ ID NO: 2926 - DNA, 21 bp, Homo sapiens
tttcaactctaatgggagaga

SEQ ID NO: 2927 - DNA, 22 bp, Homo sapiens
aaactaatctctacactgctgc

SEQ ID NO: 2928 - DNA, 21 bp, Homo sapiens
ctaatctctacactgctgccc

SEQ ID NO: 2929 - DNA, 26 bp, Homo sapiens
atggcaacaccagtcgatgggctgtc

SEQ ID NO: 2930 - DNA, 23 bp, Homo sapiens
tttcaagccagggggcgtttttc

SEQ ID NO: 2931 - DNA, 20 bp, Homo sapiens
aaagtgcatctttttagagg

SEQ ID NO: 2932 - DNA, 20 bp, Homo sapiens
gaagatctcaggttgtgacc

SEQ ID NO: 2933 - DNA, 21 bp, Homo sapiens
acattcaacctgtcggtgagt

SEQ ID NO: 2934 - DNA, 19 bp, Homo sapiens
aagtgctgtcatagctgag

SEQ ID NO: 2935 - DNA, 22 bp, Homo sapiens
aaagcgcttcccttcagagtgt

SEQ ID NO: 2936 - DNA, 23 bp, Homo sapiens
ttggacggagaactgataagggt

SEQ ID NO: 2937 - DNA, 23 bp, Homo sapiens
aagctgggttgagagggcgaaaa

SEQ ID NO: 2938 - DNA, 22 bp, Homo sapiens
ccagttaccgcttccgctaccg

SEQ ID NO: 2939 - DNA, 21 bp, Homo sapiens
gaaagcgcttctctttagagg

SEQ ID NO: 2940 - DNA, 21 bp, Homo sapiens
caacctggaggactccatgct

SEQ ID NO: 2941 - DNA, 21 bp, Homo sapiens
caaagtgcttccctttagagt

SEQ ID NO: 2942 - DNA, 21 bp, Homo sapiens
gttgaggtagtaggttgtatg

SEQ ID NO: 2943 - DNA, 22 bp, Homo sapiens
caaggagctcacagtctattga

SEQ ID NO: 2944 - DNA, 23 bp, Homo sapiens
caccaacctggaggactccatgc

SEQ ID NO: 2945 - DNA, 23 bp, Homo sapiens
ccaacctggaggactccatgctg

SEQ ID NO: 2946 - DNA, 24 bp, Homo sapiens
ctgagatgaagcactgtagctcag

SEQ ID NO: 2947 - DNA, 22 bp, Homo sapiens
caccaacctggaggactccatg

SEQ ID NO: 2948 - DNA, 21 bp, Homo sapiens
attgcacttgtcccggcctgt

SEQ ID NO: 2949 - DNA, 21 bp, Homo sapiens
caaagtgcctccctttagagt

SEQ ID NO: 2950 - DNA, 24 bp, Homo sapiens
tgagtgtactgtgggcttcggaga

SEQ ID NO: 2951 - DNA, 22 bp, Homo sapiens
agtaagtgcttccatgttttgg

SEQ ID NO: 2952 - DNA, 30 bp, Homo sapiens
caaagtgatgagtaatactggctggagccc

SEQ ID NO: 2953 - DNA, 22 bp, Homo sapiens
atgccttgagtgtaggaccgtt

SEQ ID NO: 2954 - DNA, 20 bp, Homo sapiens
agttgttcgtggtggattcg

SEQ ID NO: 2955 - DNA, 20 bp, Homo sapiens
taagtgcttccatgttttgg

SEQ ID NO: 2956 - DNA, 22 bp, Homo sapiens
aaaagtaatcactgtttttgcc

SEQ ID NO: 2957 - DNA, 21 bp, Homo sapiens
atggtgggccgcagaacatgt

SEQ ID NO: 2958 - DNA, 22 bp, Homo sapiens
caaagtgcctccctttagagtg

SEQ ID NO: 2959 - DNA, 21 bp, Homo sapiens
cggaatcccaaaagcagctgt

SEQ ID NO: 2960 - DNA, 23 bp, Homo sapiens
ggggtattgtttccgctgccagg

SEQ ID NO: 2961 - DNA, 18 bp, Homo sapiens
gtcagtttgtcaaatacc

SEQ ID NO: 2962 - DNA, 23 bp, Homo sapiens
aaagtgcttacagtgcaggtagc

SEQ ID NO: 2963 - DNA, 23 bp, Homo sapiens
cttaaacgtggatgtacttgctt

SEQ ID NO: 2964 - DNA, 20 bp, Homo sapiens
taagtgcttccatgtttgag

SEQ ID NO: 2965 - DNA, 20 bp, Homo sapiens
agaagatctcaggctgtgac

SEQ ID NO: 2966 - DNA, 19 bp, Homo sapiens
aagatctcaggttgtgacc

SEQ ID NO: 2967 - DNA, 19 bp, Homo sapiens
aagatctcaagctgtgact

SEQ ID NO: 2968 - DNA, 21 bp, Homo sapiens
tcaaaactgaggggcattttc

SEQ ID NO: 2969 - DNA, 22 bp, Homo sapiens
atcgtgcatccttttagagtgt

SEQ ID NO: 2970 - DNA, 21 bp, Homo sapiens
gcaagatctcaggctgtgacc

SEQ ID NO: 2971 - DNA, 20 bp, Homo sapiens
gaagatctcaagctgtgggt

SEQ ID NO: 2972 - DNA, 18 bp, Homo sapiens
taaagtagaaagcactac

SEQ ID NO: 2973 - DNA, 21 bp, Homo sapiens
gaccgatttctcctggtgttc

SEQ ID NO: 2974 - DNA, 20 bp, Homo sapiens
aaagcgcttcccttcagagt

SEQ ID NO: 2975 - DNA, 18 bp, Homo sapiens
agtgcttacagtgcaggt

SEQ ID NO: 2976 - DNA, 20 bp, Homo sapiens
ccacttggatctgaaggctg

SEQ ID NO: 2977 - DNA, 21 bp, Homo sapiens
ttgcaggtcgtcttgcagggc

SEQ ID NO: 2978 - DNA, 25 bp, Homo sapiens
taaacgtggatgtacttgctttgaa

SEQ ID NO: 2979 - DNA, 20 bp, Homo sapiens
cacattacacggtcgacctc

SEQ ID NO: 2980 - DNA, 20 bp, Homo sapiens
ctggccctctctgcccttcc

SEQ ID NO: 2981 - DNA, 27 bp, Homo sapiens
taaacgtggatgtacttgctttgaaac

SEQ ID NO: 2982 - DNA, 24 bp, Homo sapiens
ccatggctgtaccaccttgtcggg

SEQ ID NO: 2983 - DNA, 21 bp, Homo sapiens
aagtgcttccatgttttagta

SEQ ID NO: 2984 - DNA, 19 bp, Homo sapiens
agtgcttacagtgcaggta

SEQ ID NO: 2985 - DNA, 21 bp, Homo sapiens
aagtgcttccatgtttgagtg

SEQ ID NO: 2986 - DNA, 22 bp, Homo sapiens
actgcagtgaaggcacttgtag

SEQ ID NO: 2987 - DNA, 21 bp, Homo sapiens
ttaggccgcagatctgggtga

SEQ ID NO: 2988 - DNA, 23 bp, Homo sapiens
aagtgcttccatgtttcagtgga

SEQ ID NO: 2989 - DNA, 21 bp, Homo sapiens
acactgtctggtaacgatgtt

SEQ ID NO: 2990 - DNA, 22 bp, Homo sapiens
aaaatctctgcaggcaaatgtg

SEQ ID NO: 2991 - DNA, 23 bp, Homo sapiens
caaagttctgagacactccgact

SEQ ID NO: 2992 - DNA, 20 bp, Homo sapiens
gaccctggtctgcactctat

SEQ ID NO: 2993 - DNA, 16 bp, Homo sapiens
tatggcactggtagaa

SEQ ID NO: 2994 - DNA, 21 bp, Homo sapiens
tgaggtagtagtttgtacagt

SEQ ID NO: 2995 - DNA, 22 bp, Homo sapiens
tctctgggcctgtgtcttaggc

SEQ ID NO: 2996 - DNA, 25 bp, Homo sapiens
accctgtagatccgaatttgtgtaa

SEQ ID NO: 2997 - DNA, 21 bp, Homo sapiens
ctcggtctgaggcccctcagt

SEQ ID NO: 2998 - DNA, 22 bp, Homo sapiens
ttttgcaccttttggagtgaaa

SEQ ID NO: 2999 - DNA, 17 bp, Homo sapiens
ttgttcgttcggctcgc

SEQ ID NO: 3000 - DNA, 18 bp, Homo sapiens
tctttggttatctagctg

SEQ ID NO: 3001 - DNA, 20 bp, Homo sapiens
atgccttgagtgtaggaccg

SEQ ID NO: 3002 - DNA, 21 bp, Homo sapiens
ctgcattatgagcacttaaag

SEQ ID NO: 3003 - DNA, 21 bp, Homo sapiens
tccattacactaccctgcctc

SEQ ID NO: 3004 - DNA, 21 bp, Homo sapiens
aaaatggttccctttagagtg

SEQ ID NO: 3005 - DNA, 16 bp, Homo sapiens
cgtaccgtgagtaata

SEQ ID NO: 3006 - DNA, 20 bp, Homo sapiens
tgccctgtggactcagttct

SEQ ID NO: 3007 - DNA, 19 bp, Homo sapiens
agatgaagcactgtagctc

SEQ ID NO: 3008 - DNA, 22 bp, Homo sapiens
ttgaggtagtaggttgtatagt

SEQ ID NO: 3009 - DNA, 21 bp, Homo sapiens
gcgacccactcttggtttcca

SEQ ID NO: 3010 - DNA, 21 bp, Homo sapiens
aacacacctattcaaggattc

SEQ ID NO: 3011 - DNA, 16 bp, Homo sapiens
atggtagaactcacac

SEQ ID NO: 3012 - DNA, 20 bp, Homo sapiens
tgagcgcctcgacgacagag

SEQ ID NO: 3013 - DNA, 18 bp, Homo sapiens
tgtcagtttgtcaaatac

SEQ ID NO: 3014 - DNA, 18 bp, Homo sapiens
tttcagtcggatgtttac

SEQ ID NO: 3015 - DNA, 20 bp, Homo sapiens
tatggctttttattcctatg

SEQ ID NO: 3016 - DNA, 21 bp, Homo sapiens
aaagtgctgacagtgcagata

SEQ ID NO: 3017 - DNA, 19 bp, Homo sapiens
accatcgaccgttgagtgg

SEQ ID NO: 3018 - DNA, 19 bp, Homo sapiens
ttgcaggtcgtcttgcagg

SEQ ID NO: 3019 - DNA, 20 bp, Homo sapiens
actctttccctgttgcacta

SEQ ID NO: 3020 - DNA, 21 bp, Homo sapiens
cagtactgtgataactgaaga

SEQ ID NO: 3021 - DNA, 21 bp, Homo sapiens
aaacccgtagatccgatcttg

SEQ ID NO: 3022 - DNA, 20 bp, Homo sapiens
tgaggtagtagattgtatag

SEQ ID NO: 3023 - DNA, 16 bp, Homo sapiens
accctgtagaaccgaa

SEQ ID NO: 3024 - DNA, 21 bp, Homo sapiens
ttaaacgtggatgtacttgct

SEQ ID NO: 3025 - DNA, 21 bp, Homo sapiens
cacattgccagggattaccac

SEQ ID NO: 3026 - DNA, 20 bp, Homo sapiens
gtaactggttgaacaactga

SEQ ID NO: 3027 - DNA, 21 bp, Homo sapiens
gttcctgctgaactgagccag

SEQ ID NO: 3028 - DNA, 19 bp, Homo sapiens
taatgctaatcgtgatagg

SEQ ID NO: 3029 - DNA, 23 bp, Homo sapiens
caaagaattctccttttgggctt

SEQ ID NO: 3030 - DNA, 27 bp, Homo sapiens
cagcactagattgtaaagactggggtg

SEQ ID NO: 3031 - DNA, 22 bp, Homo sapiens
attgtgtcaatatgcgatgatg

SEQ ID NO: 3032 - DNA, 24 bp, Homo sapiens
aaagctgggttgagagggcgaaaa

SEQ ID NO: 3033 - DNA, 17 bp, Homo sapiens
tggtagaactcacactg

SEQ ID NO: 3034 - DNA, 22 bp, Homo sapiens
agggggaaagttctatagtcct

SEQ ID NO: 3035 - DNA, 24 bp, Homo sapiens
taaagctagataaccgaaagtaga

SEQ ID NO: 3036 - DNA, 22 bp, Homo sapiens
ttgttcgttcggctcgcgtgag

SEQ ID NO: 3037 - DNA, 19 bp, Homo sapiens
caggtcgtcttgcagggct

SEQ ID NO: 3038 - DNA, 20 bp, Homo sapiens
ctccagagggatgcactttc

SEQ ID NO: 3039 - DNA, 30 bp, Homo sapiens
tatggcactggtagaattcactgtgaacag

SEQ ID NO: 3040 - DNA, 22 bp, Homo sapiens
tttgataagctgacatgggaca

SEQ ID NO: 3041 - DNA, 20 bp, Homo sapiens
gtatggcactggtagaattc

SEQ ID NO: 3042 - DNA, 20 bp, Homo sapiens
caaagcacacggcctgcaga

SEQ ID NO: 3043 - DNA, 19 bp, Homo sapiens
aatcacattgccagggatt

SEQ ID NO: 3044 - DNA, 20 bp, Homo sapiens
agatcagaaggtgattgtgg

SEQ ID NO: 3045 - DNA, 22 bp, Homo sapiens
gaaggcgcttccctttagagcg

SEQ ID NO: 3046 - DNA, 19 bp, Homo sapiens
tcagtcggatgtttgcagc

SEQ ID NO: 3047 - DNA, 17 bp, Homo sapiens
acaatgtagatttctgt

SEQ ID NO: 3048 - DNA, 20 bp, Homo sapiens
ccatagaggctgtggctgga

SEQ ID NO: 3049 - DNA, 21 bp, Homo sapiens
gctacttcacaacaccagggc

SEQ ID NO: 3050 - DNA, 22 bp, Homo sapiens
gctacattgtctgctgggtttc

SEQ ID NO: 3051 - DNA, 24 bp, Homo sapiens
taagtgcttccatgttttggtgat

SEQ ID NO: 3052 - DNA, 21 bp, Homo sapiens
gcacattacacggtcgacctc

SEQ ID NO: 3053 - DNA, 21 bp, Homo sapiens
atcatgatgggctcctcggtg

SEQ ID NO: 3054 - DNA, 21 bp, Homo sapiens
cgtgttcacagcggaccttga

SEQ ID NO: 3055 - DNA, 19 bp, Homo sapiens
tgtaaacatcctacactca

SEQ ID NO: 3056 - DNA, 22 bp, Homo sapiens
atcagggcttgtggaatgggaa

SEQ ID NO: 3057 - DNA, 17 bp, Homo sapiens
gtagtctgcacattggt

SEQ ID NO: 3058 - DNA, 20 bp, Homo sapiens
gaccgatttctcctggtgtt

SEQ ID NO: 3059 - DNA, 22 bp, Homo sapiens
ctaacactgtctggtaaagatg

SEQ ID NO: 3060 - DNA, 19 bp, Homo sapiens
gtagtctgcacattggtta

SEQ ID NO: 3061 - DNA, 22 bp, Homo sapiens
tgacctatgaattgacagccag

SEQ ID NO: 3062 - DNA, 22 bp, Homo sapiens
ttgggactgatcttgatgtctg

SEQ ID NO: 3063 - DNA, 20 bp, Homo sapiens
taaggtgcatctagtgcaga

SEQ ID NO: 3064 - DNA, 19 bp, Homo sapiens
gctgcgtctttgtgctttc

SEQ ID NO: 3065 - DNA, 20 bp, Homo sapiens
tggaatgtaaggaagtgtgt

SEQ ID NO: 3066 - DNA, 19 bp, Homo sapiens
tgatctgttttgctgttgt

SEQ ID NO: 3067 - DNA, 22 bp, Homo sapiens
cacctgacctcccatgcctgtg

SEQ ID NO: 3068 - DNA, 20 bp, Homo sapiens
tgcctctgctgctggccaga

SEQ ID NO: 3069 - DNA, 18 bp, Homo sapiens
atcagactgatgttgact

SEQ ID NO: 3070 - DNA, 21 bp, Homo sapiens
cactggctcctttctgggtag

SEQ ID NO: 3071 - DNA, 22 bp, Homo sapiens
aatccttggaacctaggtgtga

SEQ ID NO: 3072 - DNA, 21 bp, Homo sapiens
tgtagggatggaagccatgaa

SEQ ID NO: 3073 - DNA, 20 bp, Homo sapiens
ttgcacggtatccatctgta

SEQ ID NO: 3074 - DNA, 24 bp, Homo sapiens
agctggtgttgtgaatcaggccga

SEQ ID NO: 3075 - DNA, 19 bp, Homo sapiens
cccgtagaaccgaccttgc

SEQ ID NO: 3076 - DNA, 20 bp, Homo sapiens
tattcatttatccccagcct

SEQ ID NO: 3077 - DNA, 22 bp, Homo sapiens
tgaggtagtagtttgtgctgtt

SEQ ID NO: 3078 - DNA, 20 bp, Homo sapiens
aagtgcttccatgtttcagt

SEQ ID NO: 3079 - DNA, 20 bp, Homo sapiens
gcaatggtagaactcacact

SEQ ID NO: 3080 - DNA, 19 bp, Homo sapiens
ttatggtttgcctgggact

SEQ ID NO: 3081 - DNA, 23 bp, Homo sapiens
actgtttgcagaggaaactgaga

SEQ ID NO: 3082 - DNA, 16 bp, Homo sapiens
caatggtagaactcac

SEQ ID NO: 3083 - DNA, 20 bp, Homo sapiens
tgcaggtcgtcttgcagggc

SEQ ID NO: 3084 - DNA, 21 bp, Homo sapiens
gattgtagccttttggagtag

SEQ ID NO: 3085 - DNA, 16 bp, Homo sapiens
aagaagttgactgaag

SEQ ID NO: 3086 - DNA, 22 bp, Homo sapiens
cgtgttcacagcggaccttgat

SEQ ID NO: 3087 - DNA, 21 bp, Homo sapiens
ctacaaaggaaagcgctttct

SEQ ID NO: 3088 - DNA, 22 bp, Homo sapiens
aaagcgcttccctttgctggat

SEQ ID NO: 3089 - DNA, 19 bp, Homo sapiens
atgacacgatcactcccgt

SEQ ID NO: 3090 - DNA, 20 bp, Homo sapiens
aaagtgctgacagtgcagat

SEQ ID NO: 3091 - DNA, 20 bp, Homo sapiens
gttcttcagtggcaagcttt

SEQ ID NO: 3092 - DNA, 20 bp, Homo sapiens
cagttatcacagtgctgatg

SEQ ID NO: 3093 - DNA, 21 bp, Homo sapiens
acagttgttcaaccagttact

SEQ ID NO: 3094 - DNA, 24 bp, Homo sapiens
ctttttgcggtctgggcttgctgt

SEQ ID NO: 3095 - DNA, 23 bp, Homo sapiens
tcctgactccaggtcctgtgtgt

SEQ ID NO: 3096 - DNA, 21 bp, Homo sapiens
aaagtgcttctctttggtggg

SEQ ID NO: 3097 - DNA, 22 bp, Homo sapiens
acaaatctccggaccacttagt

SEQ ID NO: 3098 - DNA, 20 bp, Homo sapiens
acccgtcccgttcgtccccg

SEQ ID NO: 3099 - DNA, 21 bp, Homo sapiens
aaaatctctgcaggcaaatgt

SEQ ID NO: 3100 - DNA, 23 bp, Homo sapiens
ctggactgagccgtgctactggc

SEQ ID NO: 3101 - DNA, 23 bp, Homo sapiens
ctgcaaagggaagccctttctgt

SEQ ID NO: 3102 - DNA, 25 bp, Homo sapiens
actcggcgtggcgtcggtcgtggta

SEQ ID NO: 3103 - DNA, 20 bp, Homo sapiens
tgacctatgaattgacagac

SEQ ID NO: 3104 - DNA, 19 bp, Homo sapiens
cactgtgtcctttctgcgt

SEQ ID NO: 3105 - DNA, 21 bp, Homo sapiens
ctatacgacctgctgcctttc

SEQ ID NO: 3106 - DNA, 20 bp, Homo sapiens
ttgcacttgtctcggtctga

SEQ ID NO: 3107 - DNA, 23 bp, Homo sapiens
actgccctaagtgctccttctgg

SEQ ID NO: 3108 - DNA, 20 bp, Homo sapiens
gctacattgtctgctgggtt

SEQ ID NO: 3109 - DNA, 18 bp, Homo sapiens
ccgttaccattactgagt

SEQ ID NO: 3110 - DNA, 18 bp, Homo sapiens
caccagtcgatgggctgt

SEQ ID NO: 3111 - DNA, 23 bp, Homo sapiens
tcagtaacaaagattcatccttg

SEQ ID NO: 3112 - DNA, 19 bp, Homo sapiens
tgcactacagaactttgtc

SEQ ID NO: 3113 - DNA, 20 bp, Homo sapiens
atcactaaccacacggccag

SEQ ID NO: 3114 - DNA, 20 bp, Homo sapiens
aaagtgcttctctttggtgg

SEQ ID NO: 3115 - DNA, 23 bp, Homo sapiens
catctggaggtaagaagcacttt

SEQ ID NO: 3116 - DNA, 19 bp, Homo sapiens
ctcttgagggaagcacttt

SEQ ID NO: 3117 - DNA, 23 bp, Homo sapiens
ctctagagggaagcactttctct

SEQ ID NO: 3118 - DNA, 23 bp, Homo sapiens
aagtgcttccatgttttggtgat

SEQ ID NO: 3119 - DNA, 21 bp, Homo sapiens
gtacagtactgtgataactga

SEQ ID NO: 3120 - DNA, 20 bp, Homo sapiens
ctgggaggtggatgtttact

SEQ ID NO: 3121 - DNA, 22 bp, Homo sapiens
aaactagtaatgttggattagg

SEQ ID NO: 3122 - DNA, 20 bp, Homo sapiens
gaggtagtagattgtatagt

SEQ ID NO: 3123 - DNA, 22 bp, Homo sapiens
tgtaaacatcctacactcagct

SEQ ID NO: 3124 - DNA, 21 bp, Homo sapiens
actcaaaacccttcagtgact

SEQ ID NO: 3125 - DNA, 20 bp, Homo sapiens
cgggactggccagtgttgag

SEQ ID NO: 3126 - DNA, 22 bp, Homo sapiens
ctacaaagggaagcactttctc

SEQ ID NO: 3127 - DNA, 21 bp, Homo sapiens
ctatacaatctattgccttcc

SEQ ID NO: 3128 - DNA, 20 bp, Homo sapiens
ccttcattccaccggagtct

SEQ ID NO: 3129 - DNA, 20 bp, Homo sapiens
aactagtaatgttggattag

SEQ ID NO: 3130 - DNA, 23 bp, Homo sapiens
aaagtgcttccttttagagggtt

SEQ ID NO: 3131 - DNA, 20 bp, Homo sapiens
atccgcgctctgactctctg

SEQ ID NO: 3132 - DNA, 23 bp, Homo sapiens
caaagcgcttctctttagagtgt

SEQ ID NO: 3133 - DNA, 20 bp, Homo sapiens
gcaccatctgaaatcggtta

SEQ ID NO: 3134 - DNA, 21 bp, Homo sapiens
taacagtctccagtcacggcc

SEQ ID NO: 3135 - DNA, 21 bp, Homo sapiens
ctcccacatgcagggtttgca

SEQ ID NO: 3136 - DNA, 21 bp, Homo sapiens
actagtaatgttggattaggg

SEQ ID NO: 3137 - DNA, 23 bp, Homo sapiens
aggcagtgtattgttagctggct

SEQ ID NO: 3138 - DNA, 21 bp, Homo sapiens
cctccgtgttacctgtcctct

SEQ ID NO: 3139 - DNA, 24 bp, Homo sapiens
aactggccctcaaagtcccgcttt

SEQ ID NO: 3140 - DNA, 20 bp, Homo sapiens
tacgtcatcgttgtcatcgt

SEQ ID NO: 3141 - DNA, 20 bp, Homo sapiens
acagattcgattctagggga

SEQ ID NO: 3142 - DNA, 22 bp, Homo sapiens
agaactgaattccatgggttgt

SEQ ID NO: 3143 - DNA, 22 bp, Homo sapiens
actgcatcaggaactgattgga

SEQ ID NO: 3144 - DNA, 21 bp, Homo sapiens
tagactgaagctccttgagga

SEQ ID NO: 3145 - DNA, 20 bp, Homo sapiens
ctgttgccactaacctcaac

SEQ ID NO: 3146 - DNA, 22 bp, Homo sapiens
cagccacaactaccctgccact

SEQ ID NO: 3147 - DNA, 22 bp, Homo sapiens
ctccagagggaagcgctttctg

SEQ ID NO: 3148 - DNA, 19 bp, Homo sapiens
tcgtaccgtgagtaataat

SEQ ID NO: 3149 - DNA, 21 bp, Homo sapiens
aaagcgcttccctttgctgga

SEQ ID NO: 3150 - DNA, 18 bp, Homo sapiens
attgccagggatttccaa

SEQ ID NO: 3151 - DNA, 22 bp, Homo sapiens
gaaagcgcttcccttcagagtg

SEQ ID NO: 3152 - DNA, 21 bp, Homo sapiens
accaatattactgtgctgctt

SEQ ID NO: 3153 - DNA, 20 bp, Homo sapiens
ttggtccccttcaaccagct

SEQ ID NO: 3154 - DNA, 23 bp, Homo sapiens
acaaagtgcttccctttagagtg

SEQ ID NO: 3155 - DNA, 22 bp, Homo sapiens
ttctccaaaagaaagcactttc

SEQ ID NO: 3156 - DNA, 19 bp, Homo sapiens
acatcctcgactggaagct

SEQ ID NO: 3157 - DNA, 20 bp, Homo sapiens
tatagggattggagccgtgg

SEQ ID NO: 3158 - DNA, 17 bp, Homo sapiens
ttaatgctaatcgtgat

SEQ ID NO: 3159 - DNA, 22 bp, Homo sapiens
actagactgtgagcttctagag

SEQ ID NO: 3160 - DNA, 17 bp, Homo sapiens
caaagtgctgttcgtgc

SEQ ID NO: 3161 - DNA, 23 bp, Homo sapiens
accgcactgtgggtacttgctgc

SEQ ID NO: 3162 - DNA, 21 bp, Homo sapiens
acttatcagattgtattgtaa

SEQ ID NO: 3163 - DNA, 17 bp, Homo sapiens
gttttcccaggaatccc

SEQ ID NO: 3164 - DNA, 23 bp, Homo sapiens
aaagtgctgttcgtgcaggtagt

SEQ ID NO: 3165 - DNA, 22 bp, Homo sapiens
ttgtgactgcatgctcccaggt

SEQ ID NO: 3166 - DNA, 23 bp, Homo sapiens
tactcaaaaagctgtcagtcact

SEQ ID NO: 3167 - DNA, 16 bp, Homo sapiens
attgccagggatttcc

SEQ ID NO: 3168 - DNA, 23 bp, Homo sapiens
taccctgtagaaccgaatttgtg

SEQ ID NO: 3169 - DNA, 22 bp, Homo sapiens
acctctgaaattcagttcttca

SEQ ID NO: 3170 - DNA, 22 bp, Homo sapiens
atgaggtagtagattgtatagt

SEQ ID NO: 3171 - DNA, 20 bp, Homo sapiens
ctgccctggcccgagggacc

SEQ ID NO: 3172 - DNA, 24 bp, Homo sapiens
tactgcatcaggaactgattggat

SEQ ID NO: 3173 - DNA, 19 bp, Homo sapiens
tatgccaacatattgccat

SEQ ID NO: 3174 - DNA, 21 bp, Homo sapiens
tagtgcaatattgcttatagg

SEQ ID NO: 3175 - DNA, 23 bp, Homo sapiens
accacagggtagaaccacggaca

SEQ ID NO: 3176 - DNA, 22 bp, Homo sapiens
ggactatagaactttccccctc

SEQ ID NO: 3177 - DNA, 23 bp, Homo sapiens
agctcggtctgaggcccctcagt

SEQ ID NO: 3178 - DNA, 26 bp, Homo sapiens
ccttgggagccctgttagactctgga

SEQ ID NO: 3179 - DNA, 20 bp, Homo sapiens
atcatgatgggctcctcggt

SEQ ID NO: 3180 - DNA, 21 bp, Homo sapiens
aacaaacatggtgcacttctt

SEQ ID NO: 3181 - DNA, 20 bp, Homo sapiens
ttataaagcaatgagactga

SEQ ID NO: 3182 - DNA, 21 bp, Homo sapiens
cccatagaggctgtggctgga

SEQ ID NO: 3183 - DNA, 20 bp, Homo sapiens
catcccttgcatggtggagg

SEQ ID NO: 3184 - DNA, 23 bp, Homo sapiens
aacgcgcttccctatagagggtt

SEQ ID NO: 3185 - DNA, 20 bp, Homo sapiens
aaggagcttacaatctagct

SEQ ID NO: 3186 - DNA, 21 bp, Homo sapiens
cctctagatggaagcactgtc

SEQ ID NO: 3187 - DNA, 19 bp, Homo sapiens
gaggtagtaggttgtatag

SEQ ID NO: 3188 - DNA, 17 bp, Homo sapiens
acatccccgactggaag

SEQ ID NO: 3189 - DNA, 18 bp, Homo sapiens
ccatttgaaatcagtgtt

SEQ ID NO: 3190 - DNA, 24 bp, Homo sapiens
ttcaagtaattcaggataggttgt

SEQ ID NO: 3191 - DNA, 18 bp, Homo sapiens
tactgcctggtaatgatg

SEQ ID NO: 3192 - DNA, 25 bp, Homo sapiens
ttgtgcttgatctaaccatgtggtt

SEQ ID NO: 3193 - DNA, 18 bp, Homo sapiens
gacctctgaaattcagtt

SEQ ID NO: 3194 - DNA, 24 bp, Homo sapiens
cagtgcaatagtattgtcaaagca

SEQ ID NO: 3195 - DNA, 24 bp, Homo sapiens
atggcactggtagaattcactgtg

SEQ ID NO: 3196 - DNA, 21 bp, Homo sapiens
ttcaagtaatccaggataggc

SEQ ID NO: 3197 - DNA, 20 bp, Homo sapiens
gtcatacacggctctcctct

SEQ ID NO: 3198 - DNA, 25 bp, Homo sapiens
taatccttgctacctgggtgagagt

SEQ ID NO: 3199 - DNA, 23 bp, Homo sapiens
aaagtgcatccttttagaggttt

SEQ ID NO: 3200 - DNA, 17 bp, Homo sapiens
tatgaattgacagccag

SEQ ID NO: 3201 - DNA, 19 bp, Homo sapiens
gaggatctcaggctgtgac

SEQ ID NO: 3202 - DNA, 19 bp, Homo sapiens
cagcacatcatggtttaca

SEQ ID NO: 3203 - DNA, 21 bp, Homo sapiens
tgaggtagtagtttgtgctgt

SEQ ID NO: 3204 - DNA, 19 bp, Homo sapiens
aagatctcaggctgtgtcc

SEQ ID NO: 3205 - DNA, 30 bp, Homo sapiens
cagcactagattgtaaagactggggtggac

SEQ ID NO: 3206 - DNA, 23 bp, Homo sapiens
agcgaggttgccctttgtatatt

SEQ ID NO: 3207 - DNA, 22 bp, Homo sapiens
tctacaaaggaaagcgctttct

SEQ ID NO: 3208 - DNA, 23 bp, Homo sapiens
gctacatctggctactgggtctc

SEQ ID NO: 3209 - DNA, 25 bp, Homo sapiens
tctttggttatctagctgtatgagt

SEQ ID NO: 3210 - DNA, 23 bp, Homo sapiens
tcctcctgccctccttgctgtag

SEQ ID NO: 3211 - DNA, 20 bp, Homo sapiens
gacctctgaaattcagttct

SEQ ID NO: 3212 - DNA, 19 bp, Homo sapiens
aagacgggaggaaagaagg

SEQ ID NO: 3213 - DNA, 23 bp, Homo sapiens
tttttcattattgctcctgacct

SEQ ID NO: 3214 - DNA, 20 bp, Homo sapiens
caacaaatcacagtctgcca

SEQ ID NO: 3215 - DNA, 23 bp, Homo sapiens
actcagccttgagggcactttct

SEQ ID NO: 3216 - DNA, 22 bp, Homo sapiens
aaaagctgggttgagagggcaa

SEQ ID NO: 3217 - DNA, 23 bp, Homo sapiens
taaacatcctcgactggaagctg

SEQ ID NO: 3218 - DNA, 20 bp, Homo sapiens
ccactgaccgttgactgtac

SEQ ID NO: 3219 - DNA, 22 bp, Homo sapiens
tcactggctcctttctgggtag

SEQ ID NO: 3220 - DNA, 22 bp, Homo sapiens
ctacaaaggaaagcgctttctg

SEQ ID NO: 3221 - DNA, 18 bp, Homo sapiens
cccataaagtagaaagca

SEQ ID NO: 3222 - DNA, 20 bp, Homo sapiens
ctctacagggaagcgctttc

SEQ ID NO: 3223 - DNA, 22 bp, Homo sapiens
aaagtgcttatagtgcaggtag

SEQ ID NO: 3224 - DNA, 25 bp, Homo sapiens
agctggtgttgtgaatcaggccgtt

SEQ ID NO: 3225 - DNA, 21 bp, Homo sapiens
gaaagcgcttcccttcagagt

SEQ ID NO: 3226 - DNA, 23 bp, Homo sapiens
gaacattcaacgctgtcggtgag

SEQ ID NO: 3227 - DNA, 22 bp, Homo sapiens
acaggtgaggttcttgggagcc

SEQ ID NO: 3228 - DNA, 20 bp, Homo sapiens
aatactgccgggtaatgatg

SEQ ID NO: 3229 - DNA, 21 bp, Homo sapiens
catcccttgcatggtggaggg

SEQ ID NO: 3230 - DNA, 19 bp, Homo sapiens
atgcacctgggcaaggatt

SEQ ID NO: 3231 - DNA, 23 bp, Homo sapiens
tggtgcggagagggcccacagtg

SEQ ID NO: 3232 - DNA, 24 bp, Homo sapiens
catctggaggtaagaagcactttg

SEQ ID NO: 3233 - DNA, 22 bp, Homo sapiens
tttcaagccagggggcgttttt

SEQ ID NO: 3234 - DNA, 17 bp, Homo sapiens
gttatctagctgtatga

SEQ ID NO: 3235 - DNA, 25 bp, Homo sapiens
tagtgcaatattgcttatagggttt

SEQ ID NO: 3236 - DNA, 21 bp, Homo sapiens
aatccttggaacctaggtgtg

SEQ ID NO: 3237 - DNA, 20 bp, Homo sapiens
ttgcatagtcacaaaagtga

SEQ ID NO: 3238 - DNA, 23 bp, Homo sapiens
ggactatagaactttccccctca

SEQ ID NO: 3239 - DNA, 21 bp, Homo sapiens
aagaagatctcaggctgtgtc

SEQ ID NO: 3240 - DNA, 16 bp, Homo sapiens
gccgggtaatgatgga

SEQ ID NO: 3241 - DNA, 18 bp, Homo sapiens
gtagtagattgtatagtt

SEQ ID NO: 3242 - DNA, 21 bp, Homo sapiens
agatcgaccgtgttatattcg

SEQ ID NO: 3243 - DNA, 20 bp, Homo sapiens
ccaccctgcccgggacccag

SEQ ID NO: 3244 - DNA, 22 bp, Homo sapiens
aatgcacctgggcaaggattct

SEQ ID NO: 3245 - DNA, 19 bp, Homo sapiens
tagattgtgagctcctgga

SEQ ID NO: 3246 - DNA, 21 bp, Homo sapiens
agcgcctcgacgacagagccg

SEQ ID NO: 3247 - DNA, 21 bp, Homo sapiens
acaacaaatcccagtctacct

SEQ ID NO: 3248 - DNA, 21 bp, Homo sapiens
gagaattgtggctggacatct

SEQ ID NO: 3249 - DNA, 23 bp, Homo sapiens
gaaagtgcttccctttggactgt

SEQ ID NO: 3250 - DNA, 21 bp, Homo sapiens
attctaatttctccacgtctt

SEQ ID NO: 3251 - DNA, 21 bp, Homo sapiens
cctctgggcccttcctccagc

SEQ ID NO: 3252 - DNA, 16 bp, Homo sapiens
cgctgtcggtgagttt

SEQ ID NO: 3253 - DNA, 23 bp, Homo sapiens
aaagtgcttctctttggtgggtt

SEQ ID NO: 3254 - DNA, 23 bp, Homo sapiens
gaaagcgcttcccttcagagtgt

SEQ ID NO: 3255 - DNA, 23 bp, Homo sapiens
tggcagtgtattgttagctggtt

SEQ ID NO: 3256 - DNA, 17 bp, Homo sapiens
tggagtgtgacaatggt

SEQ ID NO: 3257 - DNA, 17 bp, Homo sapiens
actcaaactgtgggggc

SEQ ID NO: 3258 - DNA, 20 bp, Homo sapiens
agaggatctcaggctgtgac

SEQ ID NO: 3259 - DNA, 20 bp, Homo sapiens
gaagatctcaggctgtgtcc

SEQ ID NO: 3260 - DNA, 16 bp, Homo sapiens
ttcacagtggctaagt

SEQ ID NO: 3261 - DNA, 21 bp, Homo sapiens
aggtagtttcatgttgttggg

SEQ ID NO: 3262 - DNA, 21 bp, Homo sapiens
aaaagtgcttacagtgcaggt

SEQ ID NO: 3263 - DNA, 21 bp, Homo sapiens
actcagccttgagggcacttt

SEQ ID NO: 3264 - DNA, 18 bp, Homo sapiens
cactgtctggtaaagatg

SEQ ID NO: 3265 - DNA, 20 bp, Homo sapiens
atactgtctggtaaaaccgt

SEQ ID NO: 3266 - DNA, 20 bp, Homo sapiens
aatgttgctcggtgaacccc

SEQ ID NO: 3267 - DNA, 20 bp, Homo sapiens
cagatcagaaggtgattgtg

SEQ ID NO: 3268 - DNA, 18 bp, Homo sapiens
tggcactggtagaattca

SEQ ID NO: 3269 - DNA, 21 bp, Homo sapiens
tgtccttgctgtttggagata

SEQ ID NO: 3270 - DNA, 23 bp, Homo sapiens
tgcagctgcctgggagtgacttc

SEQ ID NO: 3271 - DNA, 20 bp, Homo sapiens
aacatcctcgactggaagct

SEQ ID NO: 3272 - DNA, 22 bp, Homo sapiens
ccctctagatggaagcactgtc

SEQ ID NO: 3273 - DNA, 17 bp, Homo sapiens
attgccagggatttcca

SEQ ID NO: 3274 - DNA, 21 bp, Homo sapiens
aagaaccaagaatgggctgcc

SEQ ID NO: 3275 - DNA, 17 bp, Homo sapiens
gtagtaggttgtatagt

SEQ ID NO: 3276 - DNA, 25 bp, Homo sapiens
ttctccaaaagaaagcactttctgt

SEQ ID NO: 3277 - DNA, 21 bp, Homo sapiens
tttcaagccagggggcgtttt

SEQ ID NO: 3278 - DNA, 21 bp, Homo sapiens
ttcagtcggatgtttgcagct

SEQ ID NO: 3279 - DNA, 20 bp, Homo sapiens
ataaagctagataaccgaaa

SEQ ID NO: 3280 - DNA, 22 bp, Homo sapiens
gacctatgaattgacagccagt

SEQ ID NO: 3281 - DNA, 25 bp, Homo sapiens
ctgaacatccaggtctggggcatga

SEQ ID NO: 3282 - DNA, 19 bp, Homo sapiens
atcatgatgggctcctcgg

SEQ ID NO: 3283 - DNA, 20 bp, Homo sapiens
aaagtgcttcctttttgagg

SEQ ID NO: 3284 - DNA, 21 bp, Homo sapiens
acaaagtgcttccctttagag

SEQ ID NO: 3285 - DNA, 18 bp, Homo sapiens
gtaaacatcctcgactgg

SEQ ID NO: 3286 - DNA, 20 bp, Homo sapiens
aagaaccaagaatgggctgc

SEQ ID NO: 3287 - DNA, 18 bp, Homo sapiens
tggttatctagctgtatg

SEQ ID NO: 3288 - DNA, 19 bp, Homo sapiens
caaagaattctccttttgg

SEQ ID NO: 3289 - DNA, 18 bp, Homo sapiens
ccgtagatccgaacttgt

SEQ ID NO: 3290 - DNA, 23 bp, Homo sapiens
aatgttgctcggtgaaccccttt

SEQ ID NO: 3291 - DNA, 19 bp, Homo sapiens
ttagggccctggctccatc

SEQ ID NO: 3292 - DNA, 18 bp, Homo sapiens
aagatctcaggctgtgtc

SEQ ID NO: 3293 - DNA, 24 bp, Homo sapiens
tttcaagccagggggcgtttttct

SEQ ID NO: 3294 - DNA, 22 bp, Homo sapiens
aatcacacaaaggcaacttttg

SEQ ID NO: 3295 - DNA, 22 bp, Homo sapiens
aacactgtctggtaaagatggc

SEQ ID NO: 3296 - DNA, 23 bp, Homo sapiens
tccagttttcccaggaatccctt

SEQ ID NO: 3297 - DNA, 22 bp, Homo sapiens
actgtttgcagaggaaactgag

SEQ ID NO: 3298 - DNA, 16 bp, Homo sapiens
ttgtacagggctatga

SEQ ID NO: 3299 - DNA, 21 bp, Homo sapiens
actgctgagctagcacttccc

SEQ ID NO: 3300 - DNA, 22 bp, Homo sapiens
aaccatcgaccgttgagtggac

SEQ ID NO: 3301 - DNA, 23 bp, Homo sapiens
ctacaaaggaaagcgctttctgt

SEQ ID NO: 3302 - DNA, 20 bp, Homo sapiens
actagactgtgagcttctag

SEQ ID NO: 3303 - DNA, 20 bp, Homo sapiens
actatagaactttccccctc

SEQ ID NO: 3304 - DNA, 26 bp, Homo sapiens
taccctgtagaaccgaatttgtgtgg

SEQ ID NO: 3305 - DNA, 29 bp, Homo sapiens
tttggcaatggtagaactcacactggtga

SEQ ID NO: 3306 - DNA, 26 bp, Homo sapiens
atccccagatacaatggacaatatgc

SEQ ID NO: 3307 - DNA, 22 bp, Homo sapiens
caagaagatctcaggctgtgtc

SEQ ID NO: 3308 - DNA, 23 bp, Homo sapiens
gaacgcgcttccctatagagggt

SEQ ID NO: 3309 - DNA, 20 bp, Homo sapiens
tctcactgtagcctcgaacc

SEQ ID NO: 3310 - DNA, 19 bp, Homo sapiens
caacaaatcacagtctgcc

SEQ ID NO: 3311 - DNA, 20 bp, Homo sapiens
gaagatctcaagctgtgact

SEQ ID NO: 3312 - DNA, 21 bp, Homo sapiens
ctccatttgttttgatgatgg

SEQ ID NO: 3313 - DNA, 24 bp, Homo sapiens
ctgtaacagcaactccatgtggaa

SEQ ID NO: 3314 - DNA, 22 bp, Homo sapiens
caaagtgcttccctttagagtt

SEQ ID NO: 3315 - DNA, 21 bp, Homo sapiens
taatctcagctggcaactgtg

SEQ ID NO: 3316 - DNA, 19 bp, Homo sapiens
tgggtttacgttgggagaa

SEQ ID NO: 3317 - DNA, 21 bp, Homo sapiens
gaggtaggaggttgtatagtt

SEQ ID NO: 3318 - DNA, 18 bp, Homo sapiens
gcttccatgttttagtag

SEQ ID NO: 3319 - DNA, 20 bp, Homo sapiens
agaaggtctcgggctgtgac

SEQ ID NO: 3320 - DNA, 17 bp, Homo sapiens
tgaggtagtagtttgta

SEQ ID NO: 3321 - DNA, 22 bp, Homo sapiens
gagaactgaattccataggctg

SEQ ID NO: 3322 - DNA, 20 bp, Homo sapiens
gtcctgcttgtcctgcgagg

SEQ ID NO: 3323 - DNA, 21 bp, Homo sapiens
acactgtctggtaaagatggc

SEQ ID NO: 3324 - DNA, 21 bp, Homo sapiens
aagaagatctcaggctgtgac

SEQ ID NO: 3325 - DNA, 20 bp, Homo sapiens
cagtggccagagccctgcag

SEQ ID NO: 3326 - DNA, 23 bp, Homo sapiens
cgatgacctctctaacaaggtgc

SEQ ID NO: 3327 - DNA, 19 bp, Homo sapiens
tcctgcttgtcctgcgagg

SEQ ID NO: 3328 - DNA, 19 bp, Homo sapiens
ctggccctctctgcccttc

SEQ ID NO: 3329 - DNA, 24 bp, Homo sapiens
ctcttgagggaagcactttctgtt

SEQ ID NO: 3330 - DNA, 21 bp, Homo sapiens
agaagatctcaagctgtgggt

SEQ ID NO: 3331 - DNA, 18 bp, Homo sapiens
ggctcagttcagcaggaa

SEQ ID NO: 3332 - DNA, 20 bp, Homo sapiens
aatataacacagatggcctg

SEQ ID NO: 3333 - DNA, 21 bp, Homo sapiens
aggcggagacttgggcaattg

SEQ ID NO: 3334 - DNA, 20 bp, Homo sapiens
attgcacttgtctcggtctg

SEQ ID NO: 3335 - DNA, 19 bp, Homo sapiens
gaagatctcagcctgtgac

SEQ ID NO: 3336 - DNA, 19 bp, Homo sapiens
aagatctcaagctgtgggt

SEQ ID NO: 3337 - DNA, 21 bp, Homo sapiens
atctggaggtaagaagcactt

SEQ ID NO: 3338 - DNA, 17 bp, Homo sapiens
ggatctcaggctgtgac

SEQ ID NO: 3339 - DNA, 23 bp, Homo sapiens
taaggtgcatctagtgcagttag

SEQ ID NO: 3340 - DNA, 24 bp, Homo sapiens
tattcatttatccccagcctacaa

SEQ ID NO: 3341 - DNA, 22 bp, Homo sapiens
actgtagtatgggcacttccag

SEQ ID NO: 3342 - DNA, 19 bp, Homo sapiens
gctgccagttgaagaactg

SEQ ID NO: 3343 - DNA, 21 bp, Homo sapiens
ataatacatggttaacctctt

SEQ ID NO: 3344 - DNA, 20 bp, Homo sapiens
caagtgcttccttttagagg

SEQ ID NO: 3345 - DNA, 21 bp, Homo sapiens
aaagtgcttccttttagaggg

SEQ ID NO: 3346 - DNA, 21 bp, Homo sapiens
gtgacatcacatatacggcag

SEQ ID NO: 3347 - DNA, 21 bp, Homo sapiens
aggggctggctttcctctggt

SEQ ID NO: 3348 - DNA, 22 bp, Homo sapiens
tcgaggactggtggaagggcct

SEQ ID NO: 3349 - DNA, 23 bp, Homo sapiens
agatcagaaggtgattgtggctt

SEQ ID NO: 3350 - DNA, 20 bp, Homo sapiens
catcttactgggcagcattg

SEQ ID NO: 3351 - DNA, 20 bp, Homo sapiens
ccagtggggctgctgttatc

SEQ ID NO: 3352 - DNA, 25 bp, Homo sapiens
ctgagaactgaattccataggctgt

SEQ ID NO: 3353 - DNA, 21 bp, Homo sapiens
ctctagatggaagcactgtct

SEQ ID NO: 3354 - DNA, 22 bp, Homo sapiens
ctcctgccctccttgctgtaga

SEQ ID NO: 3355 - DNA, 23 bp, Homo sapiens
tgatatgtttgatattgggttgt

SEQ ID NO: 3356 - DNA, 24 bp, Homo sapiens
gtagaggagatggcgcaggggaca

SEQ ID NO: 3357 - DNA, 20 bp, Homo sapiens
aaggcagggcccccgctccc

SEQ ID NO: 3358 - DNA, 20 bp, Homo sapiens
ccgttaccattactgagttt

SEQ ID NO: 3359 - DNA, 20 bp, Homo sapiens
attctaatttctccacgtct

SEQ ID NO: 3360 - DNA, 20 bp, Homo sapiens
gttcacagtggctaagttct

SEQ ID NO: 3361 - DNA, 22 bp, Homo sapiens
aatgttgctcggtgaacccctt

SEQ ID NO: 3362 - DNA, 20 bp, Homo sapiens
gaagatctcaggctgtgacc

SEQ ID NO: 3363 - DNA, 20 bp, Homo sapiens
acctggcatacaatgtagat

SEQ ID NO: 3364 - DNA, 23 bp, Homo sapiens
agggacgggacgcggtgcagtgt

SEQ ID NO: 3365 - DNA, 22 bp, Homo sapiens
cctctaaagggaagcgctttct

SEQ ID NO: 3366 - DNA, 23 bp, Homo sapiens
tgattgaaacctctaagagtgga

SEQ ID NO: 3367 - DNA, 19 bp, Homo sapiens
ctgcgcaagctactgcctt

SEQ ID NO: 3368 - DNA, 20 bp, Homo sapiens
gaatatctcaggctgtgacc

SEQ ID NO: 3369 - DNA, 20 bp, Homo sapiens
gaagatgtcaggctgtgacc

SEQ ID NO: 3370 - DNA, 21 bp, Homo sapiens
agaagatctcaggctgtgtcc

SEQ ID NO: 3371 - DNA, 22 bp, Homo sapiens
ttctccaaaagggagcactttc

SEQ ID NO: 3372 - DNA, 19 bp, Homo sapiens
ctagattgtgagctcctgg

SEQ ID NO: 3373 - DNA, 22 bp, Homo sapiens
gtaattttatgtataagctagt

SEQ ID NO: 3374 - DNA, 22 bp, Homo sapiens
actcaaaacccttcagtgactt

SEQ ID NO: 3375 - DNA, 25 bp, Homo sapiens
cacccaagtcaggtactcgaatgga

SEQ ID NO: 3376 - DNA, 23 bp, Homo sapiens
ccctgtagatccgaatttgtgta

SEQ ID NO: 3377 - DNA, 20 bp, Homo sapiens
agaagatctcagcctgtgac

SEQ ID NO: 3378 - DNA, 19 bp, Homo sapiens
cagtgcactacagaacttt

SEQ ID NO: 3379 - DNA, 19 bp, Homo sapiens
aaacatcctcgactggaag

SEQ ID NO: 3380 - DNA, 19 bp, Homo sapiens
aagatgtcaggctgtgacc

SEQ ID NO: 3381 - DNA, 21 bp, Homo sapiens
tgaggagatcgtcgaggttgg

SEQ ID NO: 3382 - DNA, 20 bp, Homo sapiens
tcatacacggttgacctatt

SEQ ID NO: 3383 - DNA, 22 bp, Homo sapiens
tgggactgatcttgatgtctgc

SEQ ID NO: 3384 - DNA, 19 bp, Homo sapiens
tatgtgcctttggactaca

SEQ ID NO: 3385 - DNA, 20 bp, Homo sapiens
taaacatccccgactggaag

SEQ ID NO: 3386 - DNA, 20 bp, Homo sapiens
aacattcaacctgtcggtga

SEQ ID NO: 3387 - DNA, 20 bp, Homo sapiens
ttctcgaggaaagaagcact

SEQ ID NO: 3388 - DNA, 16 bp, Homo sapiens
cacccgtagaaccgac

SEQ ID NO: 3389 - DNA, 22 bp, Homo sapiens
aagaagatctcaggctgtgtcc

SEQ ID NO: 3390 - DNA, 19 bp, Homo sapiens
atactgcctggtaatgatg

SEQ ID NO: 3391 - DNA, 20 bp, Homo sapiens
gaagatctcaagctgtgagt

SEQ ID NO: 3392 - DNA, 22 bp, Homo sapiens
tgtgggacttctggccttgact

SEQ ID NO: 3393 - DNA, 21 bp, Homo sapiens
atcagggcttgtggaatggga

SEQ ID NO: 3394 - DNA, 20 bp, Homo sapiens
ctgtacaaccttctagcttt

SEQ ID NO: 3395 - DNA, 23 bp, Homo sapiens
gaaagcgcttccctttgctggat

SEQ ID NO: 3396 - DNA, 23 bp, Homo sapiens
aaagtgcttccctttggactgtt

SEQ ID NO: 3397 - DNA, 19 bp, Homo sapiens
tgagcgcctcgacgacaga

SEQ ID NO: 3398 - DNA, 22 bp, Homo sapiens
actgtacaggccactgccttgc

SEQ ID NO: 3399 - DNA, 19 bp, Homo sapiens
aagatctcatgctgtgact

SEQ ID NO: 3400 - DNA, 20 bp, Homo sapiens
actggttgaacaactgaacc

SEQ ID NO: 3401 - DNA, 22 bp, Homo sapiens
gttctcccaacgtaagcccagc

SEQ ID NO: 3402 - DNA, 21 bp, Homo sapiens
atggttgaccatagaacatgc

SEQ ID NO: 3403 - DNA, 21 bp, Homo sapiens
agaagatctcaagctgtgagt

SEQ ID NO: 3404 - DNA, 22 bp, Homo sapiens
atatacagggggagactcttat

SEQ ID NO: 3405 - DNA, 22 bp, Homo sapiens
tgattgaaacctctaagagtgg

SEQ ID NO: 3406 - DNA, 25 bp, Homo sapiens
atggcactggtagaattcactgtga

SEQ ID NO: 3407 - DNA, 21 bp, Homo sapiens
ctacaaagggaagccctttct

SEQ ID NO: 3408 - DNA, 21 bp, Homo sapiens
gaggagatcgtcgaggttggc

SEQ ID NO: 3409 - DNA, 19 bp, Homo sapiens
gaagacctcaggctgtgac

SEQ ID NO: 3410 - DNA, 20 bp, Homo sapiens
catatgtctgctgaccatca

SEQ ID NO: 3411 - DNA, 21 bp, Homo sapiens
ttctagtaagagtggcagtcg

SEQ ID NO: 3412 - DNA, 22 bp, Homo sapiens
ttgtgaaatgtttaggaccact

SEQ ID NO: 3413 - DNA, 19 bp, Homo sapiens
aagatctcaagctgtgagt

SEQ ID NO: 3414 - DNA, 21 bp, Homo sapiens
agtgctgttcgtgcaggtagt

SEQ ID NO: 3415 - DNA, 24 bp, Homo sapiens
ctccagagggaagcgctttctgtt

SEQ ID NO: 3416 - DNA, 20 bp, Homo sapiens
gtgcattgctgttgcattgc

SEQ ID NO: 3417 - DNA, 22 bp, Homo sapiens
gatttcagtggagtgaagttca

SEQ ID NO: 3418 - DNA, 22 bp, Homo sapiens
tagattctccttctatgagtac

SEQ ID NO: 3419 - DNA, 18 bp, Homo sapiens
aagacctcaggctgtgac

SEQ ID NO: 3420 - DNA, 20 bp, Homo sapiens
atcgtgcatccctttagagt

SEQ ID NO: 3421 - DNA, 24 bp, Homo sapiens
gaaaatgatgagtagtgactgatg

SEQ ID NO: 3422 - DNA, 22 bp, Homo sapiens
tgagatgaagcactgtagctca

SEQ ID NO: 3423 - DNA, 23 bp, Homo sapiens
ctacaaagggaagcactttctct

SEQ ID NO: 3424 - DNA, 25 bp, Homo sapiens
agcttatcagactgatgttgactgt

SEQ ID NO: 3425 - DNA, 21 bp, Homo sapiens
agaagatctcaagctgtgact

SEQ ID NO: 3426 - DNA, 20 bp, Homo sapiens
ctatacggcctcctagcttt

SEQ ID NO: 3427 - DNA, 21 bp, Homo sapiens
tggctgtaccaccttgtcggg

SEQ ID NO: 3428 - DNA, 26 bp, Homo sapiens
tgtaaacatccttgactggaagctgt

SEQ ID NO: 3429 - DNA, 20 bp, Homo sapiens
aattgcacggtatccatctg

SEQ ID NO: 3430 - DNA, 23 bp, Homo sapiens
aagcccttaccccaaaaagcatt

SEQ ID NO: 3431 - DNA, 19 bp, Homo sapiens
gcaccatttgaaatcggtt

SEQ ID NO: 3432 - DNA, 17 bp, Homo sapiens
agactatggaacgtagg

SEQ ID NO: 3433 - DNA, 25 bp, Homo sapiens
tattgcacttgtcccggcctgtgga

SEQ ID NO: 3434 - DNA, 23 bp, Homo sapiens
catcgggaatgtcgtgtccgccc

SEQ ID NO: 3435 - DNA, 19 bp, Homo sapiens
aagatctcatgctgtgacc

SEQ ID NO: 3436 - DNA, 22 bp, Homo sapiens
gtgatatcatggttcctgggag

SEQ ID NO: 3437 - DNA, 19 bp, Homo sapiens
actgccgggtaatgatgga

SEQ ID NO: 3438 - DNA, 22 bp, Homo sapiens
cagattcgattctaggggaata

SEQ ID NO: 3439 - DNA, 21 bp, Homo sapiens
tgagcgcctcgacgacagagc

SEQ ID NO: 3440 - DNA, 21 bp, Homo sapiens
agaagatctcaggttgtgacc

SEQ ID NO: 3441 - DNA, 23 bp, Homo sapiens
ataagattgggtcctagtagtac

SEQ ID NO: 3442 - DNA, 18 bp, Homo sapiens
gagatgaagcactgtagc

SEQ ID NO: 3443 - DNA, 22 bp, Homo sapiens
tcagtgcatcacagaactttgt

SEQ ID NO: 3444 - DNA, 18 bp, Homo sapiens
cagtatagatgatgtact

SEQ ID NO: 3445 - DNA, 20 bp, Homo sapiens
gaagatctcatgctgtgacc

SEQ ID NO: 3446 - DNA, 22 bp, Homo sapiens
ataggactcatatagtgccagg

SEQ ID NO: 3447 - DNA, 21 bp, Homo sapiens
tgcacctgggcaaggattctg

SEQ ID NO: 3448 - DNA, 21 bp, Homo sapiens
cggttgaccatggtgtgtacg

SEQ ID NO: 3449 - DNA, 22 bp, Homo sapiens
tatggtttgcctgggactgagg

SEQ ID NO: 3450 - DNA, 20 bp, Homo sapiens
taccgcactgtgggtacttg

SEQ ID NO: 3451 - DNA, 18 bp, Homo sapiens
taagtgcttccatgtttt

SEQ ID NO: 3452 - DNA, 20 bp, Homo sapiens
tgtatggcactggtagaatt

SEQ ID NO: 3453 - DNA, 21 bp, Homo sapiens
aaggcgcttccctttagagcg

SEQ ID NO: 3454 - DNA, 22 bp, Homo sapiens
cacaactagactgtgagcttct

SEQ ID NO: 3455 - DNA, 22 bp, Homo sapiens
tgtagggctaaaagccatgggc

SEQ ID NO: 3456 - DNA, 21 bp, Homo sapiens
actgtttgcagaggaaactga

SEQ ID NO: 3457 - DNA, 19 bp, Homo sapiens
ctctggagggaagcacttt

SEQ ID NO: 3458 - DNA, 24 bp, Homo sapiens
actgtgcgtgtgacagcggctgat

SEQ ID NO: 3459 - DNA, 19 bp, Homo sapiens
cgggaacgtcgagactgga

SEQ ID NO: 3460 - DNA, 18 bp, Homo sapiens
ctgcctggtaatgatgac

SEQ ID NO: 3461 - DNA, 23 bp, Homo sapiens
tcagtgcactacagaactttgtc

SEQ ID NO: 3462 - DNA, 22 bp, Homo sapiens
gagcgcctcgacgacagagccg

SEQ ID NO: 3463 - DNA, 24 bp, Homo sapiens
catcttaccggacagtgctggatt

SEQ ID NO: 3464 - DNA, 19 bp, Homo sapiens
ttttctgcaggcctctgtg

SEQ ID NO: 3465 - DNA, 19 bp, Homo sapiens
agctcggtctgaggcccct

SEQ ID NO: 3466 - DNA, 21 bp, Homo sapiens
atggtttaccgtcccacatac

SEQ ID NO: 3467 - DNA, 21 bp, Homo sapiens
tgtctcccaacccttgtacca

SEQ ID NO: 3468 - DNA, 20 bp, Homo sapiens
ggcactggtagaattcactg

SEQ ID NO: 3469 - DNA, 19 bp, Homo sapiens
tgttcgttcggctcgcgtg

SEQ ID NO: 3470 - DNA, 21 bp, Homo sapiens
gtaattttatgtataagctag

SEQ ID NO: 3471 - DNA, 20 bp, Homo sapiens
gtgcagtgctgcatctctgg

SEQ ID NO: 3472 - DNA, 20 bp, Homo sapiens
caaagtgcctccctttagag

SEQ ID NO: 3473 - DNA, 22 bp, Homo sapiens
actagattgtgagctcctggag

SEQ ID NO: 3474 - DNA, 20 bp, Homo sapiens
acagggtagaaccacggaca

SEQ ID NO: 3475 - DNA, 23 bp, Homo sapiens
acaaagtgcttccctttagagtt

SEQ ID NO: 3476 - DNA, 20 bp, Homo sapiens
agtagtctgcacattggtta

SEQ ID NO: 3477 - DNA, 21 bp, Homo sapiens
aaagtgcatctttttagagga

SEQ ID NO: 3478 - DNA, 18 bp, Homo sapiens
cccagtgttcagactacc

SEQ ID NO: 3479 - DNA, 22 bp, Homo sapiens
aacactgtctggtaacgatgtt

SEQ ID NO: 3480 - DNA, 19 bp, Homo sapiens
gctccagccctgccggggc

SEQ ID NO: 3481 - DNA, 22 bp, Homo sapiens
tgttcctgctgaactgagccag

SEQ ID NO: 3482 - DNA, 18 bp, Homo sapiens
gcactggtagaattcact

SEQ ID NO: 3483 - DNA, 19 bp, Homo sapiens
cagtgcacgtgtctccagt

SEQ ID NO: 3484 - DNA, 21 bp, Homo sapiens
ggactatagaactttccccct

SEQ ID NO: 3485 - DNA, 20 bp, Homo sapiens
aagtgctgcgacatttgagc

SEQ ID NO: 3486 - DNA, 23 bp, Homo sapiens
cagcagcaattcatgttttgaag

SEQ ID NO: 3487 - DNA, 20 bp, Homo sapiens
caaagcgctcccctttagag

SEQ ID NO: 3488 - DNA, 21 bp, Homo sapiens
aaagtgcatccttttagagtg

SEQ ID NO: 3489 - DNA, 23 bp, Homo sapiens
accgttaccattactgagtttag

SEQ ID NO: 3490 - DNA, 21 bp, Homo sapiens
taaacatccttgactggaagc

SEQ ID NO: 3491 - DNA, 22 bp, Homo sapiens
ctttcagtcggatgtttgcagc

SEQ ID NO: 3492 - DNA, 23 bp, Homo sapiens
agagtctccagtaatggacggga

SEQ ID NO: 3493 - DNA, 20 bp, Homo sapiens
gtcaacacttgctggtttcc

SEQ ID NO: 3494 - DNA, 19 bp, Homo sapiens
tactgtctggtaaaaccgt

SEQ ID NO: 3495 - DNA, 22 bp, Homo sapiens
ctgagaactgaattccataggc

SEQ ID NO: 3496 - DNA, 23 bp, Homo sapiens
tcgaggactggtggaagggcctt

SEQ ID NO: 3497 - DNA, 23 bp, Homo sapiens
atggcaacaccagtcgatgggct

SEQ ID NO: 3498 - DNA, 16 bp, Homo sapiens
gcactacagaactttg

SEQ ID NO: 3499 - DNA, 22 bp, Homo sapiens
gtgacatcacatatacggcagc

SEQ ID NO: 3500 - DNA, 21 bp, Homo sapiens
actgtgcgtgtgacagcggct

SEQ ID NO: 3501 - DNA, 20 bp, Homo sapiens
gtgcctactgagctgatatc

SEQ ID NO: 3502 - DNA, 22 bp, Homo sapiens
ctcgtgggctctggccacggcc

SEQ ID NO: 3503 - DNA, 20 bp, Homo sapiens
ctctagctgccaaaggcgct

SEQ ID NO: 3504 - DNA, 25 bp, Homo sapiens
tgtcagtttgtcaaataccccaagt

SEQ ID NO: 3505 - DNA, 23 bp, Homo sapiens
gagtgccttcttttggagcgtta

SEQ ID NO: 3506 - DNA, 21 bp, Homo sapiens
gtgtgcggaaatgcttctgct

SEQ ID NO: 3507 - DNA, 23 bp, Homo sapiens
ctccagagggaagtactttctgt

SEQ ID NO: 3508 - DNA, 24 bp, Homo sapiens
tcaacaaaatcactgatgctggag

SEQ ID NO: 3509 - DNA, 22 bp, Homo sapiens
cgtgtcttttgctctgcagtca

SEQ ID NO: 3510 - DNA, 24 bp, Homo sapiens
tgattggtacgtctgtgggtagag

SEQ ID NO: 3511 - DNA, 22 bp, Homo sapiens
ataccctgtagaaccgaatttg

SEQ ID NO: 3512 - DNA, 18 bp, Homo sapiens
cacattgccagggattac

SEQ ID NO: 3513 - DNA, 24 bp, Homo sapiens
tgtaaacatcctacactctcagct

SEQ ID NO: 3514 - DNA, 21 bp, Homo sapiens
atcgtacagggtcatccactt

SEQ ID NO: 3515 - DNA, 21 bp, Homo sapiens
caacaacattaaaccacccga

SEQ ID NO: 3516 - DNA, 24 bp, Homo sapiens
gggagccaggaagtattgatgttt

SEQ ID NO: 3517 - DNA, 20 bp, Homo sapiens
tgaccgatttctcctggtgt

SEQ ID NO: 3518 - DNA, 21 bp, Homo sapiens
gtgaacgggcgccatcccgag

SEQ ID NO: 3519 - DNA, 20 bp, Homo sapiens
aatcgtacagggtcatccac

SEQ ID NO: 3520 - DNA, 18 bp, Homo sapiens
ctagcaccatttgaaatc

SEQ ID NO: 3521 - DNA, 21 bp, Homo sapiens
ctgggtttacgttgggagaac

SEQ ID NO: 3522 - DNA, 18 bp, Homo sapiens
gtgctgacagtgcagata

SEQ ID NO: 3523 - DNA, 21 bp, Homo sapiens
acagcagcaattcatgttttg

SEQ ID NO: 3524 - DNA, 19 bp, Homo sapiens
ttaatatcggacaaccatt

SEQ ID NO: 3525 - DNA, 19 bp, Homo sapiens
attcctggaaatactgttc

SEQ ID NO: 3526 - DNA, 24 bp, Homo sapiens
acattcattgctgtcggtgggttt

SEQ ID NO: 3527 - DNA, 24 bp, Homo sapiens
taaagaggtatagggcatgggaaa

SEQ ID NO: 3528 - DNA, 19 bp, Homo sapiens
taaacgtggatgtacttgc

SEQ ID NO: 3529 - DNA, 19 bp, Homo sapiens
tgcttccatgttttagtag

SEQ ID NO: 3530 - DNA, 29 bp, Homo sapiens
taaacgtggatgtacttgctttgaaacta

SEQ ID NO: 3531 - DNA, 16 bp, Homo sapiens
tattgcactcgtcccg

SEQ ID NO: 3532 - DNA, 20 bp, Homo sapiens
ctcactgatcaatgaatgca

SEQ ID NO: 3533 - DNA, 21 bp, Homo sapiens
tgattgacacttctgtgagta

SEQ ID NO: 3534 - DNA, 20 bp, Homo sapiens
caacaaatcccagtctacct

SEQ ID NO: 3535 - DNA, 18 bp, Homo sapiens
agtgctgttcgtgcaggt

SEQ ID NO: 3536 - DNA, 21 bp, Homo sapiens
cagcattgtacagggctatga

SEQ ID NO: 3537 - DNA, 20 bp, Homo sapiens
aactggcctacaaagtccca

SEQ ID NO: 3538 - DNA, 21 bp, Homo sapiens
tgggactgatcttgatgtctg

SEQ ID NO: 3539 - DNA, 22 bp, Homo sapiens
atggtaccctggcatactgagt

SEQ ID NO: 3540 - DNA, 18 bp, Homo sapiens
acatccccgactggaagc

SEQ ID NO: 3541 - DNA, 21 bp, Homo sapiens
tcgtgcatccttttagagtgt

SEQ ID NO: 3542 - DNA, 22 bp, Homo sapiens
caagaagatctcaggctgtgac

SEQ ID NO: 3543 - DNA, 21 bp, Homo sapiens
cggacaggcgttcgtgcgacg

SEQ ID NO: 3544 - DNA, 23 bp, Homo sapiens
aaagtgcttcctttttgagggtt

SEQ ID NO: 3545 - DNA, 21 bp, Homo sapiens
ttcactggagtttgtttcaat

SEQ ID NO: 3546 - DNA, 21 bp, Homo sapiens
tcaacaaaatcactgatgctg

SEQ ID NO: 3547 - DNA, 20 bp, Homo sapiens
gtaacagcaactccatgtgg

SEQ ID NO: 3548 - DNA, 21 bp, Homo sapiens
tccgtctcagttactttatag

SEQ ID NO: 3549 - DNA, 19 bp, Homo sapiens
ctagcaccatttgaaatca

SEQ ID NO: 3550 - DNA, 20 bp, Homo sapiens
tatgtaacacggtccactaa

SEQ ID NO: 3551 - DNA, 21 bp, Homo sapiens
gctacatctggctactgggtc

SEQ ID NO: 3552 - DNA, 23 bp, Homo sapiens
atcacattgccagggatttccaa

SEQ ID NO: 3553 - DNA, 20 bp, Homo sapiens
atataacacagatggcctgt

SEQ ID NO: 3554 - DNA, 23 bp, Homo sapiens
cctccgtgttacctgtcctctag

SEQ ID NO: 3555 - DNA, 21 bp, Homo sapiens
tcacagtgaaccggtctcttt

SEQ ID NO: 3556 - DNA, 22 bp, Homo sapiens
caacaccagtcgatgggctgtc

SEQ ID NO: 3557 - DNA, 22 bp, Homo sapiens
cggggccgtagcactgtctgag

SEQ ID NO: 3558 - DNA, 21 bp, Homo sapiens
agttaggattaggtcgtggaa

SEQ ID NO: 3559 - DNA, 20 bp, Homo sapiens
cctgtagaaccgaatttgtg

SEQ ID NO: 3560 - DNA, 19 bp, Homo sapiens
atcatcgtctcaaatgagt

SEQ ID NO: 3561 - DNA, 21 bp, Homo sapiens
acgggttaggctcttgggagc

SEQ ID NO: 3562 - DNA, 20 bp, Homo sapiens
agggggaaagttctatagtc

SEQ ID NO: 3563 - DNA, 21 bp, Homo sapiens
gtctgagatgaagcactgtag

SEQ ID NO: 3564 - DNA, 21 bp, Homo sapiens
gtgtttcctactttatggatg

SEQ ID NO: 3565 - DNA, 21 bp, Homo sapiens
ttcacagggaggtgtcattta

SEQ ID NO: 3566 - DNA, 22 bp, Homo sapiens
tttgggactgatcttgatgtct

SEQ ID NO: 3567 - DNA, 23 bp, Homo sapiens
gccctgtggactcagttctggtg

SEQ ID NO: 3568 - DNA, 21 bp, Homo sapiens
tcatgatgggctcctcggtgt

SEQ ID NO: 3569 - DNA, 20 bp, Homo sapiens
actgcagtgaaggcacttgt

SEQ ID NO: 3570 - DNA, 19 bp, Homo sapiens
tcgaggactggtggaaggg

SEQ ID NO: 3571 - DNA, 25 bp, Homo sapiens
tccttcattccaccggagtctgtct

SEQ ID NO: 3572 - DNA, 22 bp, Homo sapiens
ttgattgacacttctgtgagta

SEQ ID NO: 3573 - DNA, 19 bp, Homo sapiens
ttggtccccttcaaccagc

SEQ ID NO: 3574 - DNA, 20 bp, Homo sapiens
ctcccaacccttgtaccagt

SEQ ID NO: 3575 - DNA, 18 bp, Homo sapiens
tcacattgccagggatta

SEQ ID NO: 3576 - DNA, 17 bp, Homo sapiens
agtactgtgataactga

SEQ ID NO: 3577 - DNA, 19 bp, Homo sapiens
ttgtacatggtaggctttc

SEQ ID NO: 3578 - DNA, 16 bp, Homo sapiens
cgaacctgagccactg

SEQ ID NO: 3579 - DNA, 24 bp, Homo sapiens
tggaatgtaaggaagtgtgtggtt

SEQ ID NO: 3580 - DNA, 20 bp, Homo sapiens
gacctatgaattgacagcca

SEQ ID NO: 3581 - DNA, 21 bp, Homo sapiens
attgacacctctgtgagtgga

SEQ ID NO: 3582 - DNA, 19 bp, Homo sapiens
tgcaccatggttgtctgag

SEQ ID NO: 3583 - DNA, 23 bp, Homo sapiens
gctggtttcacatggtggcttag

SEQ ID NO: 3584 - DNA, 20 bp, Homo sapiens
ttgattgacacttctgtgag

SEQ ID NO: 3585 - DNA, 16 bp, Homo sapiens
attgccagggattacc

SEQ ID NO: 3586 - DNA, 17 bp, Homo sapiens
acatcctacactcagct

SEQ ID NO: 3587 - DNA, 22 bp, Homo sapiens
aaaagctgggttgagagggcga

SEQ ID NO: 3588 - DNA, 20 bp, Homo sapiens
cagcagcacactgtggtttg

SEQ ID NO: 3589 - DNA, 21 bp, Homo sapiens
gagggccccccctcaatcctg

SEQ ID NO: 3590 - DNA, 18 bp, Homo sapiens
taaacgtggatgtacttg

SEQ ID NO: 3591 - DNA, 21 bp, Homo sapiens
cttaaacgtggatgtacttgc

SEQ ID NO: 3592 - DNA, 22 bp, Homo sapiens
tcagtaacaaagattcatcctt

SEQ ID NO: 3593 - DNA, 20 bp, Homo sapiens
atctggaggtaagaagcact

SEQ ID NO: 3594 - DNA, 22 bp, Homo sapiens
accgttaccattactgagttta

SEQ ID NO: 3595 - DNA, 20 bp, Homo sapiens
agttcttcagtggcaagctt

SEQ ID NO: 3596 - DNA, 23 bp, Homo sapiens
atctggaggtaagaagcactttg

SEQ ID NO: 3597 - DNA, 22 bp, Homo sapiens
aacgcacttccctttagagtgt

SEQ ID NO: 3598 - DNA, 20 bp, Homo sapiens
tcagcaccaggatattgttg

SEQ ID NO: 3599 - DNA, 23 bp, Homo sapiens
ttaaacgtggatgtacttgcttt

SEQ ID NO: 3600 - DNA, 19 bp, Homo sapiens
taagtgcttccatgtttta

SEQ ID NO: 3601 - DNA, 21 bp, Homo sapiens
catcagttcctaatgcattgc

SEQ ID NO: 3602 - DNA, 22 bp, Homo sapiens
catcagttcctaatgcattgcc

SEQ ID NO: 3603 - DNA, 24 bp, Homo sapiens
tgtaaacatcctcgactggaagct

SEQ ID NO: 3604 - DNA, 20 bp, Homo sapiens
atcatagaggaaaatccacg

SEQ ID NO: 3605 - DNA, 19 bp, Homo sapiens
agaattctccttttgggct

SEQ ID NO: 3606 - DNA, 24 bp, Homo sapiens
taagtgcttccatgttttagtagg

SEQ ID NO: 3607 - DNA, 19 bp, Homo sapiens
actctagagggaagcgctt

SEQ ID NO: 3608 - DNA, 17 bp, Homo sapiens
aacccgtagatccgatc

SEQ ID NO: 3609 - DNA, 17 bp, Homo sapiens
attgccagggattacca

SEQ ID NO: 3610 - DNA, 21 bp, Homo sapiens
atcgtgcatccctttagagtg

SEQ ID NO: 3611 - DNA, 18 bp, Homo sapiens
agtagtctgcacattggt

SEQ ID NO: 3612 - DNA, 20 bp, Homo sapiens
agctggtgttgtgaatcagg

SEQ ID NO: 3613 - DNA, 19 bp, Homo sapiens
agcttatcagactgatgtt

SEQ ID NO: 3614 - DNA, 23 bp, Homo sapiens
tttgataagctgacatgggacag

SEQ ID NO: 3615 - DNA, 19 bp, Homo sapiens
acatccccgactggaagct

SEQ ID NO: 3616 - DNA, 21 bp, Homo sapiens
gtaaacatcctacactcagct

SEQ ID NO: 3617 - DNA, 23 bp, Homo sapiens
ctccagagggatgcactttctct

SEQ ID NO: 3618 - DNA, 20 bp, Homo sapiens
ctgtgctctgggggctgtgc

SEQ ID NO: 3619 - DNA, 19 bp, Homo sapiens
gtgttcagactacctgttc

SEQ ID NO: 3620 - DNA, 24 bp, Homo sapiens
ctgagaactgaattccataggctg

SEQ ID NO: 3621 - DNA, 19 bp, Homo sapiens
aggcagtgtagttagctga

SEQ ID NO: 3622 - DNA, 22 bp, Homo sapiens
ttatcagaatctccaggggtac

SEQ ID NO: 3623 - DNA, 19 bp, Homo sapiens
atcgaccgttgattgtacc

SEQ ID NO: 3624 - DNA, 17 bp, Homo sapiens
ctgtctggtaaaaccgt

SEQ ID NO: 3625 - DNA, 19 bp, Homo sapiens
ggctcagtagccagtgtag

SEQ ID NO: 3626 - DNA, 19 bp, Homo sapiens
ctgtatgccctcaccgctc

SEQ ID NO: 3627 - DNA, 22 bp, Homo sapiens
actggacttggagtcagaaggc

SEQ ID NO: 3628 - DNA, 20 bp, Homo sapiens
atcacattgccagggatttc

SEQ ID NO: 3629 - DNA, 20 bp, Homo sapiens
ccctgagaccctaacttgtg

SEQ ID NO: 3630 - DNA, 21 bp, Homo sapiens
ttcacagtggctaagttccgc

SEQ ID NO: 3631 - DNA, 24 bp, Homo sapiens
tggcaacaccagtcgatgggctgt

SEQ ID NO: 3632 - DNA, 25 bp, Homo sapiens
catctggaggtaagaagcactttgt

SEQ ID NO: 3633 - DNA, 21 bp, Homo sapiens
caacattcattgctgtcggtg

SEQ ID NO: 3634 - DNA, 20 bp, Homo sapiens
aacacacctggttaacctct

SEQ ID NO: 3635 - DNA, 20 bp, Homo sapiens
attgcactttagcaatggtg

SEQ ID NO: 3636 - DNA, 20 bp, Homo sapiens
tcaaaactgaggggcatttt

SEQ ID NO: 3637 - DNA, 22 bp, Homo sapiens
acgggttaggctcttgggagct

SEQ ID NO: 3638 - DNA, 15 bp, Homo sapiens
ctttcagtcggatgt

SEQ ID NO: 3639 - DNA, 26 bp, Homo sapiens
gtgaacgggcgccatcccgaggcttt

SEQ ID NO: 3640 - DNA, 24 bp, Homo sapiens
ataaagctagataaccgaaagtaa

SEQ ID NO: 3641 - DNA, 20 bp, Homo sapiens
cgaccggacctcgaccggct

SEQ ID NO: 3642 - DNA, 21 bp, Homo sapiens
aatactgtctggtaaaaccgt

SEQ ID NO: 3643 - DNA, 23 bp, Homo sapiens
ttgcatagtcacaaaagtgatca

SEQ ID NO: 3644 - DNA, 22 bp, Homo sapiens
gattggtacgtctgtgggtaga

SEQ ID NO: 3645 - DNA, 19 bp, Homo sapiens
aagcccttaccccaaaaag

SEQ ID NO: 3646 - DNA, 23 bp, Homo sapiens
aaagcgcttccctttgctggatt

SEQ ID NO: 3647 - DNA, 21 bp, Homo sapiens
tgcctactgagctgatatcag

SEQ ID NO: 3648 - DNA, 18 bp, Homo sapiens
attgccagggattaccac

SEQ ID NO: 3649 - DNA, 20 bp, Homo sapiens
tactgcatcaggaactgatt

SEQ ID NO: 3650 - DNA, 20 bp, Homo sapiens
ctcccacacccaaggcttgc

SEQ ID NO: 3651 - DNA, 20 bp, Homo sapiens
tcttaccagacatggttaga

SEQ ID NO: 3652 - DNA, 22 bp, Homo sapiens
catcagaattcatggaggctag

SEQ ID NO: 3653 - DNA, 20 bp, Homo sapiens
atcatcgtctcaaatgagtc

SEQ ID NO: 3654 - DNA, 22 bp, Homo sapiens
gtaaacatcctacactctcagc

SEQ ID NO: 3655 - DNA, 19 bp, Homo sapiens
atggttgaccagagagcac

SEQ ID NO: 3656 - DNA, 21 bp, Homo sapiens
atcattcacggacaacacttt

SEQ ID NO: 3657 - DNA, 21 bp, Homo sapiens
cggggcagctcagtacaggat

SEQ ID NO: 3658 - DNA, 23 bp, Homo sapiens
aagctgccagttgaagaactgtt

SEQ ID NO: 3659 - DNA, 25 bp, Homo sapiens
aggttacccgagcaactttgcatct

SEQ ID NO: 3660 - DNA, 20 bp, Homo sapiens
ttcacagtggctaagttccg

SEQ ID NO: 3661 - DNA, 17 bp, Homo sapiens
cgtagatccgaacttgt

SEQ ID NO: 3662 - DNA, 19 bp, Homo sapiens
cacactgggttgggcaagg

SEQ ID NO: 3663 - DNA, 22 bp, Homo sapiens
cacccgtcccgttcgtccccgg

SEQ ID NO: 3664 - DNA, 21 bp, Homo sapiens
ccaatattactgtgctgcttt

SEQ ID NO: 3665 - DNA, 18 bp, Homo sapiens
gctacatctggctactgg

SEQ ID NO: 3666 - DNA, 17 bp, Homo sapiens
tctttggttatctagct

SEQ ID NO: 3667 - DNA, 18 bp, Homo sapiens
tgaaatgtttaggaccac

SEQ ID NO: 3668 - DNA, 21 bp, Homo sapiens
tcgaggactggtggaagggcc

SEQ ID NO: 3669 - DNA, 20 bp, Homo sapiens
gtgcttccatgttttagtag

SEQ ID NO: 3670 - DNA, 22 bp, Homo sapiens
gtaagtgcttccatgttttggt

SEQ ID NO: 3671 - DNA, 23 bp, Homo sapiens
agtaagtgcttccatgttttggt

SEQ ID NO: 3672 - DNA, 20 bp, Homo sapiens
aagtgcttccatgttttggt

SEQ ID NO: 3673 - DNA, 20 bp, Homo sapiens
tttaacatgggggtacctgc

SEQ ID NO: 3674 - DNA, 21 bp, Homo sapiens
actttaacatggaggcacttg

SEQ ID NO: 3675 - DNA, 21 bp, Homo sapiens
agtgcttccatgttttagtag

SEQ ID NO: 3676 - DNA, 17 bp, Homo sapiens
cttccatgttttagtag

SEQ ID NO: 3677 - DNA, 21 bp, Homo sapiens
atcacacaaaggcaacttttg

SEQ ID NO: 3678 - DNA, 21 bp, Homo sapiens
tacccattgcatatcggagtt

SEQ ID NO: 3679 - DNA, 17 bp, Homo sapiens
aatggtagaactcacac

SEQ ID NO: 3680 - DNA, 23 bp, Homo sapiens
accttggctctagactgcttact

SEQ ID NO: 3681 - DNA, 17 bp, Homo sapiens
tacaatgtagatttctg

SEQ ID NO: 3682 - DNA, 18 bp, Homo sapiens
agcacgtaaatattggcg

SEQ ID NO: 3683 - DNA, 18 bp, Homo sapiens
caaaatcactgatgctgg

SEQ ID NO: 3684 - DNA, 19 bp, Homo sapiens
gctacatctggctactggg

SEQ ID NO: 3685 - DNA, 20 bp, Homo sapiens
aaggcgcttccctttagagc

SEQ ID NO: 3686 - DNA, 19 bp, Homo sapiens
gctacattgtctgctgggt

SEQ ID NO: 3687 - DNA, 19 bp, Homo sapiens
acactgtctggtaaagatg

SEQ ID NO: 3688 - DNA, 18 bp, Homo sapiens
acatcctacactctcagc

SEQ ID NO: 3689 - DNA, 22 bp, Homo sapiens
tgtaaacatccttgactggaag

SEQ ID NO: 3690 - DNA, 24 bp, Homo sapiens
tgaggtagtagattgtatagtttt

SEQ ID NO: 3691 - DNA, 20 bp, Homo sapiens
gtcaggcggctcggactgag

SEQ ID NO: 3692 - DNA, 23 bp, Homo sapiens
ttggcagtgtcttagctggttgt

SEQ ID NO: 3693 - DNA, 22 bp, Homo sapiens
agctggtaaaatggaaccaaat

SEQ ID NO: 3694 - DNA, 24 bp, Homo sapiens
agatcagaaggtgattgtggcttt

SEQ ID NO: 3695 - DNA, 18 bp, Homo sapiens
cattgcacttgtctcggt

SEQ ID NO: 3696 - DNA, 24 bp, Homo sapiens
tgaggtagtaggttgtatagtttg

SEQ ID NO: 3697 - DNA, 18 bp, Homo sapiens
tgcaggtcgtcttgcagg

SEQ ID NO: 3698 - DNA, 21 bp, Homo sapiens
aagtgcatccttttagagtgt

SEQ ID NO: 3699 - DNA, 19 bp, Homo sapiens
ctccagagggaagtacttt

SEQ ID NO: 3700 - DNA, 25 bp, Homo sapiens
taggcagtgtattgctagcggctgt

SEQ ID NO: 3701 - DNA, 21 bp, Homo sapiens
ctggtttcacatggtggctta

SEQ ID NO: 3702 - DNA, 19 bp, Homo sapiens
aatgtttaggaccactaga

SEQ ID NO: 3703 - DNA, 22 bp, Homo sapiens
acatgcttctttatatccccat

SEQ ID NO: 3704 - DNA, 23 bp, Homo sapiens
ttttgcaatatgttcctgaatat

SEQ ID NO: 3705 - DNA, 19 bp, Homo sapiens
ataccctgtagatccgaat

SEQ ID NO: 3706 - DNA, 23 bp, Homo sapiens
catcagaattcatggaggctaga

SEQ ID NO: 3707 - DNA, 17 bp, Homo sapiens
agcttatcagactgatg

SEQ ID NO: 3708 - DNA, 17 bp, Homo sapiens
gtgaaatgtttaggacc

SEQ ID NO: 3709 - DNA, 18 bp, Homo sapiens
tagcaccatttgaaatca

SEQ ID NO: 3710 - DNA, 19 bp, Homo sapiens
tgctgacatatttactaga

SEQ ID NO: 3711 - DNA, 21 bp, Homo sapiens
gaattgtggctggacatctgt

SEQ ID NO: 3712 - DNA, 17 bp, Homo sapiens
gatgctggcatagctgt

SEQ ID NO: 3713 - DNA, 22 bp, Homo sapiens
atcatagaggaaaatccacgtt

SEQ ID NO: 3714 - DNA, 23 bp, Homo sapiens
tgatatgtttgatatattaggtt

SEQ ID NO: 3715 - DNA, 16 bp, Homo sapiens
agtggctaagttccgc

SEQ ID NO: 3716 - DNA, 19 bp, Homo sapiens
ccaccgccggccgatgggc

SEQ ID NO: 3717 - DNA, 22 bp, Homo sapiens
gcctgtctacacttgctgtgca

SEQ ID NO: 3718 - DNA, 21 bp, Homo sapiens
ggaatgtaaggaagtgtgtgg

SEQ ID NO: 3719 - DNA, 23 bp, Homo sapiens
actcaaaatgggggcgctttcct

SEQ ID NO: 3720 - DNA, 20 bp, Homo sapiens
agaactgaattccatgggtt

SEQ ID NO: 3721 - DNA, 20 bp, Homo sapiens
tacccattgcatatcggagt

SEQ ID NO: 3722 - DNA, 20 bp, Homo sapiens
tttcctatgcatatacttct

SEQ ID NO: 3723 - DNA, 20 bp, Homo sapiens
actccatttgttttgatgat

SEQ ID NO: 3724 - DNA, 21 bp, Homo sapiens
tgaggtaggaggttgtatagt

SEQ ID NO: 3725 - DNA, 24 bp, Homo sapiens
atccccagatacaatggacaatat

SEQ ID NO: 3726 - DNA, 18 bp, Homo sapiens
ctatgaattgacagccag

SEQ ID NO: 3727 - DNA, 22 bp, Homo sapiens
tgtgcttgatctaaccatgtgg

SEQ ID NO: 3728 - DNA, 22 bp, Homo sapiens
tctgcaaagggaagccctttct

SEQ ID NO: 3729 - DNA, 19 bp, Homo sapiens
cctatgaattgacagccag

SEQ ID NO: 3730 - DNA, 21 bp, Homo sapiens
accgtggctttcgattgttac

SEQ ID NO: 3731 - DNA, 18 bp, Homo sapiens
ggtagtagattgtatagt

SEQ ID NO: 3732 - DNA, 19 bp, Homo sapiens
tactccagagggcgtcact

SEQ ID NO: 3733 - DNA, 23 bp, Homo sapiens
aaactctacttgtccttctgagt

SEQ ID NO: 3734 - DNA, 23 bp, Homo sapiens
ctcagtctcatctgcaaagaagt

SEQ ID NO: 3735 - DNA, 22 bp, Homo sapiens
tcctcgactggaagctgtgaag

SEQ ID NO: 3736 - DNA, 23 bp, Homo sapiens
agatgggctttcagtcggatgtt

SEQ ID NO: 3737 - DNA, 21 bp, Homo sapiens
agcagcacgtaaatattggcg

SEQ ID NO: 3738 - DNA, 21 bp, Homo sapiens
cagcccggatcccagcccact

SEQ ID NO: 3739 - DNA, 23 bp, Homo sapiens
caacaaatcacagtctgccatat

SEQ ID NO: 3740 - DNA, 19 bp, Homo sapiens
tgcaggtcgtcttgcaggg

SEQ ID NO: 3741 - DNA, 21 bp, Homo sapiens
gtcactagtggttccgtttag

SEQ ID NO: 3742 - DNA, 21 bp, Homo sapiens
gatttcagtggagtgaagttc

SEQ ID NO: 3743 - DNA, 15 bp, Homo sapiens
agtggctaagttccg

SEQ ID NO: 3744 - DNA, 20 bp, Homo sapiens
ggattcctggaaatactgtt

SEQ ID NO: 3745 - DNA, 21 bp, Homo sapiens
aaagcgcttctctttagagga

SEQ ID NO: 3746 - DNA, 16 bp, Homo sapiens
gtagaaccgaatttgt

SEQ ID NO: 3747 - DNA, 24 bp, Homo sapiens
tctttcgggccgtagagccagggc

SEQ ID NO: 3748 - DNA, 20 bp, Homo sapiens
aggtagtttcatgttgttgg

SEQ ID NO: 3749 - DNA, 18 bp, Homo sapiens
cagcaactccatgtggaa

SEQ ID NO: 3750 - DNA, 20 bp, Homo sapiens
ggagctcacagtctattgag

SEQ ID NO: 3751 - DNA, 19 bp, Homo sapiens
catagaggaaattccacgt

SEQ ID NO: 3752 - DNA, 20 bp, Homo sapiens
agaattctccttttgggctt

SEQ ID NO: 3753 - DNA, 22 bp, Homo sapiens
agtctgagatgaagcactgtag

SEQ ID NO: 3754 - DNA, 21 bp, Homo sapiens
ccaatattggctgtgctgctc

SEQ ID NO: 3755 - DNA, 26 bp, Homo sapiens
aacattcattgctgtcggtgggttga

SEQ ID NO: 3756 - DNA, 24 bp, Homo sapiens
gtatggcactggtagaattcactg

SEQ ID NO: 3757 - DNA, 20 bp, Homo sapiens
tactccagagggcgtcactc

SEQ ID NO: 3758 - DNA, 18 bp, Homo sapiens
ggtagtaagttgtattgt

SEQ ID NO: 3759 - DNA, 23 bp, Homo sapiens
taacagtctacagccatggtcgc

SEQ ID NO: 3760 - DNA, 23 bp, Homo sapiens
aagtgctgtcatagctgaggtcc

SEQ ID NO: 3761 - DNA, 18 bp, Homo sapiens
tcggctctgggtctgtgg

SEQ ID NO: 3762 - DNA, 19 bp, Homo sapiens
gcaccatttgaaatcagtg

SEQ ID NO: 3763 - DNA, 24 bp, Homo sapiens
agcagcattgtacagggctatcaa

SEQ ID NO: 3764 - DNA, 15 bp, Homo sapiens
cgctgtcggtgagtt

SEQ ID NO: 3765 - DNA, 16 bp, Homo sapiens
tcggatccgtctgagc

SEQ ID NO: 3766 - DNA, 23 bp, Homo sapiens
atcatgatgggctcctcggtgtt

SEQ ID NO: 3767 - DNA, 21 bp, Homo sapiens
aaacgccattatcacactaaa

SEQ ID NO: 3768 - DNA, 19 bp, Homo sapiens
cgaatgttgctcggtgaac

SEQ ID NO: 3769 - DNA, 22 bp, Homo sapiens
tagtgcaatattgcttataggg

SEQ ID NO: 3770 - DNA, 21 bp, Homo sapiens
aagtgcttccctttggactgt

SEQ ID NO: 3771 - DNA, 21 bp, Homo sapiens
aaacattcgcggtgcacttct

SEQ ID NO: 3772 - DNA, 19 bp, Homo sapiens
gaactgaattccatgggtt

SEQ ID NO: 3773 - DNA, 20 bp, Homo sapiens
ttcacaaggaggtgtcattt

SEQ ID NO: 3774 - DNA, 21 bp, Homo sapiens
cacagtggtctctgggattat

SEQ ID NO: 3775 - DNA, 22 bp, Homo sapiens
aagtgcttccttttagagggtt

SEQ ID NO: 3776 - DNA, 20 bp, Homo sapiens
aggcagtgtagttagctgat

SEQ ID NO: 3777 - DNA, 19 bp, Homo sapiens
cctcccgggcccctgtgag

SEQ ID NO: 3778 - DNA, 19 bp, Homo sapiens
aacaggtgactggttagac

SEQ ID NO: 3779 - DNA, 23 bp, Homo sapiens
ttctctgttttggccatgtgtgt

SEQ ID NO: 3780 - DNA, 22 bp, Homo sapiens
cctggaaacactgaggttgtgt

SEQ ID NO: 3781 - DNA, 20 bp, Homo sapiens
atctgtctgtcttctgtata

SEQ ID NO: 3782 - DNA, 22 bp, Homo sapiens
ataagacgaacaaaaggtttgt

SEQ ID NO: 3783 - DNA, 21 bp, Homo sapiens
ctccagccccacagcctcagc

SEQ ID NO: 3784 - DNA, 18 bp, Homo sapiens
caacaccagtcgatgggc

SEQ ID NO: 3785 - DNA, 24 bp, Homo sapiens
aggcagtgtattgctagcggctgt

SEQ ID NO: 3786 - DNA, 23 bp, Homo sapiens
gtatgtgcctttggactacatcg

SEQ ID NO: 3787 - DNA, 21 bp, Homo sapiens
tcatcgtctcaaatgagtctt

SEQ ID NO: 3788 - DNA, 21 bp, Homo sapiens
ctgaggtagtagtttgtacag

SEQ ID NO: 3789 - DNA, 20 bp, Homo sapiens
taacagcaactccatgtgga

SEQ ID NO: 3790 - DNA, 28 bp, Homo sapiens
cagcactagattgtaaagactggggtgg

SEQ ID NO: 3791 - DNA, 22 bp, Homo sapiens
catcggatccgtctgagcttgg

SEQ ID NO: 3792 - DNA, 18 bp, Homo sapiens
ctgccgggtaatgatgga

SEQ ID NO: 3793 - DNA, 20 bp, Homo sapiens
acactgtctggtaaagatgg

SEQ ID NO: 3794 - DNA, 17 bp, Homo sapiens
ctgtgacacttcaaact

SEQ ID NO: 3795 - DNA, 19 bp, Homo sapiens
gtgcactacagaactttgt

SEQ ID NO: 3796 - DNA, 23 bp, Homo sapiens
cctctagatggaagcactgtctg

SEQ ID NO: 3797 - DNA, 21 bp, Homo sapiens
agagcttagctgattggtgaa

SEQ ID NO: 3798 - DNA, 19 bp, Homo sapiens
actatagaactttccccct

SEQ ID NO: 3799 - DNA, 21 bp, Homo sapiens
cagtgcatcacagaactttgt

SEQ ID NO: 3800 - DNA, 21 bp, Homo sapiens
ccataaagtagaaagcactac

SEQ ID NO: 3801 - DNA, 16 bp, Homo sapiens
gcacgtaaatattggc

SEQ ID NO: 3802 - DNA, 24 bp, Homo sapiens
ttgcatagtcacaaaagtgatcat

SEQ ID NO: 3803 - DNA, 25 bp, Homo sapiens
aatccttggaacctaggtgtgagtg

SEQ ID NO: 3804 - DNA, 18 bp, Homo sapiens
ttcaacgctgtcggtgag

SEQ ID NO: 3805 - DNA, 19 bp, Homo sapiens
gactgaagctccttgagga

SEQ ID NO: 3806 - DNA, 23 bp, Homo sapiens
ccctctagatggaagcactgtct

SEQ ID NO: 3807 - DNA, 23 bp, Homo sapiens
aaagtgcttacagtgcaggtagt

SEQ ID NO: 3808 - DNA, 21 bp, Homo sapiens
ttggtccccttcaaccagcta

SEQ ID NO: 3809 - DNA, 20 bp, Homo sapiens
aggagaaaggacccttccag

SEQ ID NO: 3810 - DNA, 24 bp, Homo sapiens
tgattgtagccttttggagtagag

SEQ ID NO: 3811 - DNA, 22 bp, Homo sapiens
ctgttgccactaacctcaacct

SEQ ID NO: 3812 - DNA, 23 bp, Homo sapiens
atggaatgtaaggaagtgtgtgg

SEQ ID NO: 3813 - DNA, 15 bp, Homo sapiens
tcttcccggagtcgg

SEQ ID NO: 3814 - DNA, 21 bp, Homo sapiens
ctctttccctgttgcactact

SEQ ID NO: 3815 - DNA, 19 bp, Homo sapiens
atgctgacatatttactag

SEQ ID NO: 3816 - DNA, 21 bp, Homo sapiens
aaacatggttccgtcaagcac

SEQ ID NO: 3817 - DNA, 21 bp, Homo sapiens
ggagacgcggccctgttggag

SEQ ID NO: 3818 - DNA, 20 bp, Homo sapiens
ggagacgcggccctgttgga

SEQ ID NO: 3819 - DNA, 20 bp, Homo sapiens
ttcaacgggtatttattgag

SEQ ID NO: 3820 - DNA, 17 bp, Homo sapiens
cccataaagtagaaagc

SEQ ID NO: 3821 - DNA, 22 bp, Homo sapiens
gtaacagcaactccatgtggaa

SEQ ID NO: 3822 - DNA, 18 bp, Homo sapiens
actagtgattttgttgtt

SEQ ID NO: 3823 - DNA, 18 bp, Homo sapiens
cagtgcaatgttaaaagg

SEQ ID NO: 3824 - DNA, 22 bp, Homo sapiens
tatgtaacatggtccactaact

SEQ ID NO: 3825 - DNA, 21 bp, Homo sapiens
ttgaaaggctatttcttggtc

SEQ ID NO: 3826 - DNA, 18 bp, Homo sapiens
tttgtgacctggtccact

SEQ ID NO: 3827 - DNA, 20 bp, Homo sapiens
agttaggattaggtcgtgga

SEQ ID NO: 3828 - DNA, 19 bp, Homo sapiens
ctccagagggatgcacttt

SEQ ID NO: 3829 - DNA, 22 bp, Homo sapiens
tccctgagaccctaacttgtga

SEQ ID NO: 3830 - DNA, 16 bp, Homo sapiens
tttgttcgttcggctc

SEQ ID NO: 3831 - DNA, 22 bp, Homo sapiens
gctggtttcatatggtggttta

SEQ ID NO: 3832 - DNA, 24 bp, Homo sapiens
taatccttgctacctgggtgagag

SEQ ID NO: 3833 - DNA, 18 bp, Homo sapiens
cagtgcacgtgtctccag

SEQ ID NO: 3834 - DNA, 17 bp, Homo sapiens
actggtagaattcactg

SEQ ID NO: 3835 - DNA, 20 bp, Homo sapiens
tccgagcctgggtctccctc

SEQ ID NO: 3836 - DNA, 18 bp, Homo sapiens
gtgtgacaatggtgtttg

SEQ ID NO: 3837 - DNA, 21 bp, Homo sapiens
caacaaatcccagtctaccta

SEQ ID NO: 3838 - DNA, 18 bp, Homo sapiens
ctgtatgccctcaccgct

SEQ ID NO: 3839 - DNA, 22 bp, Homo sapiens
tgggcgtatctgtatgctaggg

SEQ ID NO: 3840 - DNA, 25 bp, Homo sapiens
taccacagggtagaaccacggacag

SEQ ID NO: 3841 - DNA, 21 bp, Homo sapiens
gtcttaccagacatggttaga

SEQ ID NO: 3842 - DNA, 21 bp, Homo sapiens
atcacattgccagtgattacc

SEQ ID NO: 3843 - DNA, 22 bp, Homo sapiens
aagtgcctccttttagagtgtt

SEQ ID NO: 3844 - DNA, 21 bp, Homo sapiens
gtgcattgctgttgcattgca

SEQ ID NO: 3845 - DNA, 19 bp, Homo sapiens
ctcactgatcaatgaatgc

SEQ ID NO: 3846 - DNA, 21 bp, Homo sapiens
ccctgaacgaggggtctggag

SEQ ID NO: 3847 - DNA, 24 bp, Homo sapiens
atgcaccatggttgtctgagcatg

SEQ ID NO: 3848 - DNA, 19 bp, Homo sapiens
gaagatctcaggctgtcgt

SEQ ID NO: 3849 - DNA, 20 bp, Homo sapiens
aatcacattgccagggattt

SEQ ID NO: 3850 - DNA, 20 bp, Homo sapiens
ggagtgtgacaatggtgttt

SEQ ID NO: 3851 - DNA, 22 bp, Homo sapiens
agaaagcgcttccctttgctgg

SEQ ID NO: 3852 - DNA, 20 bp, Homo sapiens
tacccagagcatgcagtgtg

SEQ ID NO: 3853 - DNA, 21 bp, Homo sapiens
ttttcattattgctcctgacc

SEQ ID NO: 3854 - DNA, 22 bp, Homo sapiens
tagtcccttccttgaagcggtc

SEQ ID NO: 3855 - DNA, 22 bp, Homo sapiens
tacttggaaaggcatcagttgc

SEQ ID NO: 3856 - DNA, 18 bp, Homo sapiens
aagatctcagcctgtgac

SEQ ID NO: 3857 - DNA, 22 bp, Homo sapiens
gagggccccccctcaatcctgt

SEQ ID NO: 3858 - DNA, 19 bp, Homo sapiens
ccgtagatccgaacttgtg

SEQ ID NO: 3859 - DNA, 23 bp, Homo sapiens
gtagataaaatattggtacctga

SEQ ID NO: 3860 - DNA, 19 bp, Homo sapiens
gtgtttagactatctgttc

SEQ ID NO: 3861 - DNA, 20 bp, Homo sapiens
tgctaatcgtgataggggtt

SEQ ID NO: 3862 - DNA, 22 bp, Homo sapiens
caagcttgtatctataggtatg

SEQ ID NO: 3863 - DNA, 21 bp, Homo sapiens
cccaccctgcccgggacccag

SEQ ID NO: 3864 - DNA, 19 bp, Homo sapiens
gttcctgagctgttggatt

SEQ ID NO: 3865 - DNA, 17 bp, Homo sapiens
gctgttcgtgcaggtag

SEQ ID NO: 3866 - DNA, 24 bp, Homo sapiens
tttggcaatggtagaactcacact

SEQ ID NO: 3867 - DNA, 23 bp, Homo sapiens
ctctagaggaagcactttctgtt

SEQ ID NO: 3868 - DNA, 20 bp, Homo sapiens
aaagtgctgcgacatttgag

SEQ ID NO: 3869 - DNA, 18 bp, Homo sapiens
ttcgttcggctcgcgtga

SEQ ID NO: 3870 - DNA, 19 bp, Homo sapiens
tggtcgaccagttggaaag

SEQ ID NO: 3871 - DNA, 20 bp, Homo sapiens
gtggttttaccctatggtag

SEQ ID NO: 3872 - DNA, 20 bp, Homo sapiens
aaagtgctgttcgtgcaggt

SEQ ID NO: 3873 - DNA, 19 bp, Homo sapiens
tgtaacagcaactccatgt

SEQ ID NO: 3874 - DNA, 18 bp, Homo sapiens
cgtagatccgaacttgtg

SEQ ID NO: 3875 - DNA, 23 bp, Homo sapiens
atcgtgcatccctttagagtgtt

SEQ ID NO: 3876 - DNA, 21 bp, Homo sapiens
aaagtgcttccttttagaggc

SEQ ID NO: 3877 - DNA, 19 bp, Homo sapiens
ttcattccaccggagtctg

SEQ ID NO: 3878 - DNA, 20 bp, Homo sapiens
aaacatcctcgactggaagc

SEQ ID NO: 3879 - DNA, 17 bp, Homo sapiens
catcctcgactggaagc

SEQ ID NO: 3880 - DNA, 17 bp, Homo sapiens
ctgtagaaccgaatttg

SEQ ID NO: 3881 - DNA, 19 bp, Homo sapiens
gaagttgttcgtggtggat

SEQ ID NO: 3882 - DNA, 19 bp, Homo sapiens
cacagtggtctctgggatt

SEQ ID NO: 3883 - DNA, 24 bp, Homo sapiens
tcaggctcagtcccctcccgataa

SEQ ID NO: 3884 - DNA, 19 bp, Homo sapiens
aaagctgggttgagagggc

SEQ ID NO: 3885 - DNA, 18 bp, Homo sapiens
ataaagctagataaccga

SEQ ID NO: 3886 - DNA, 21 bp, Homo sapiens
agaggttgcccttggtgaatt

SEQ ID NO: 3887 - DNA, 22 bp, Homo sapiens
aatcatagaggaaaatccacgt

SEQ ID NO: 3888 - DNA, 18 bp, Homo sapiens
ctcagttcagcaggaaca

SEQ ID NO: 3889 - DNA, 20 bp, Homo sapiens
ttgaaaggctatttcttggt

SEQ ID NO: 3890 - DNA, 19 bp, Homo sapiens
tctggctccgtgtcttcac

SEQ ID NO: 3891 - DNA, 21 bp, Homo sapiens
taggacacatggtctacttct

SEQ ID NO: 3892 - DNA, 18 bp, Homo sapiens
tatgtctgctgaccatca

SEQ ID NO: 3893 - DNA, 22 bp, Homo sapiens
tagcagcacatcatggtttaca

SEQ ID NO: 3894 - DNA, 22 bp, Homo sapiens
aggtgcagtgctgcatctctgg

SEQ ID NO: 3895 - DNA, 18 bp, Homo sapiens
aggatctcaggctgtgac

SEQ ID NO: 3896 - DNA, 18 bp, Homo sapiens
gcaatggtagaactcaca

SEQ ID NO: 3897 - DNA, 21 bp, Homo sapiens
caatgtttccacagtgcatca

SEQ ID NO: 3898 - DNA, 19 bp, Homo sapiens
atactgtctggtaaaaccg

SEQ ID NO: 3899 - DNA, 18 bp, Homo sapiens
gcaatgttaaaagggcat

SEQ ID NO: 3900 - DNA, 20 bp, Homo sapiens
cggctctgggtctgtgggga

SEQ ID NO: 3901 - DNA, 21 bp, Homo sapiens
acgcccttcccccccttcttc

SEQ ID NO: 3902 - DNA, 21 bp, Homo sapiens
actgcatcaggaactgattgg

SEQ ID NO: 3903 - DNA, 18 bp, Homo sapiens
tactgtctggtaaaaccg

SEQ ID NO: 3904 - DNA, 21 bp, Homo sapiens
ttctccaaaagaaagcacttt

SEQ ID NO: 3905 - DNA, 20 bp, Homo sapiens
cttggcacctagcaagcact

SEQ ID NO: 3906 - DNA, 23 bp, Homo sapiens
gtcatttttgtgatgttgcagct

SEQ ID NO: 3907 - DNA, 21 bp, Homo sapiens
ctctaaagggaagcgctttct

SEQ ID NO: 3908 - DNA, 16 bp, Homo sapiens
tttcagtcggatgttt

SEQ ID NO: 3909 - DNA, 24 bp, Homo sapiens
acctggacccagcgtagacaaaga

SEQ ID NO: 3910 - DNA, 22 bp, Homo sapiens
agagtgccttcttttggagcgt

SEQ ID NO: 3911 - DNA, 18 bp, Homo sapiens
gcacttgtctcggtctga

SEQ ID NO: 3912 - DNA, 19 bp, Homo sapiens
actgtagtatgggcacttc

SEQ ID NO: 3913 - DNA, 19 bp, Homo sapiens
agaattgtggctggacatc

SEQ ID NO: 3914 - DNA, 18 bp, Homo sapiens
actgtctggtaaaaccgt

SEQ ID NO: 3915 - DNA, 22 bp, Homo sapiens
tgaaacatacacgggaaacctc

SEQ ID NO: 3916 - DNA, 20 bp, Homo sapiens
atgttctcttcactgtggga

SEQ ID NO: 3917 - DNA, 30 bp, Homo sapiens
cgctcatgatgagcaaactgagcctctaag

SEQ ID NO: 3918 - DNA, 20 bp, Homo sapiens
aagctcggtctgaggcccct

SEQ ID NO: 3919 - DNA, 20 bp, Homo sapiens
gaactgaattccataggctg

SEQ ID NO: 3920 - DNA, 21 bp, Homo sapiens
aagaggatctcaggctgtgac

SEQ ID NO: 3921 - DNA, 26 bp, Homo sapiens
agcttatcagactgatgttgactgtt

SEQ ID NO: 3922 - DNA, 19 bp, Homo sapiens
tctaagaagttgactgaag

SEQ ID NO: 3923 - DNA, 25 bp, Homo sapiens
taggtagtttcctgttgttgggatc

SEQ ID NO: 3924 - DNA, 23 bp, Homo sapiens
cagtggttttaccctatggtagg

SEQ ID NO: 3925 - DNA, 25 bp, Homo sapiens
tttggtccccttcaaccagctgtag

SEQ ID NO: 3926 - DNA, 21 bp, Homo sapiens
aagttgcccgtgtttttttcg

SEQ ID NO: 3927 - DNA, 17 bp, Homo sapiens
ctcttgagggaagcact

SEQ ID NO: 3928 - DNA, 23 bp, Homo sapiens
ctcaagatggaagcagtttctgt

SEQ ID NO: 3929 - DNA, 25 bp, Homo sapiens
atggcaacaccagtcgatgggctgt

SEQ ID NO: 3930 - DNA, 22 bp, Homo sapiens
cgaataatacatggttgatctt

SEQ ID NO: 3931 - DNA, 21 bp, Homo sapiens
gattggtacgtctgtgggtag

SEQ ID NO: 3932 - DNA, 18 bp, Homo sapiens
catcctcgactggaagct

SEQ ID NO: 3933 - DNA, 22 bp, Homo sapiens
tcaggtgtggaaactgaggcag

SEQ ID NO: 3934 - DNA, 22 bp, Homo sapiens
gctggtaaaatggaaccaaatc

SEQ ID NO: 3935 - DNA, 21 bp, Homo sapiens
tatggtttgcctgggactgag

SEQ ID NO: 3936 - DNA, 25 bp, Homo sapiens
aggcagtgtattgctagcggctgtt

SEQ ID NO: 3937 - DNA, 22 bp, Homo sapiens
acgcgcttccctatagagggtt

SEQ ID NO: 3938 - DNA, 23 bp, Homo sapiens
agttttgcaggtttgcatccagc

SEQ ID NO: 3939 - DNA, 20 bp, Homo sapiens
atactgcatcaggaactgat

SEQ ID NO: 3940 - DNA, 21 bp, Homo sapiens
caaatctccggaccacttagt

SEQ ID NO: 3941 - DNA, 19 bp, Homo sapiens
gacctatgaattgacagcc

SEQ ID NO: 3942 - DNA, 18 bp, Homo sapiens
cttttcattcctatgtga

SEQ ID NO: 3943 - DNA, 19 bp, Homo sapiens
cctctgggcccttcctcca

SEQ ID NO: 3944 - DNA, 18 bp, Homo sapiens
ttcagtcggatgtttgca

SEQ ID NO: 3945 - DNA, 21 bp, Homo sapiens
ggcaatggtagaactcacact

SEQ ID NO: 3946 - DNA, 17 bp, Homo sapiens
gtagtagtttgtgctgt

SEQ ID NO: 3947 - DNA, 24 bp, Homo sapiens
ggccgcgctcgaggggtccccgtg

SEQ ID NO: 3948 - DNA, 28 bp, Homo sapiens
ttcatgatactgtaaacgctttctgatg

SEQ ID NO: 3949 - DNA, 23 bp, Homo sapiens
aagctcggtctgaggcccctcag

SEQ ID NO: 3950 - DNA, 18 bp, Homo sapiens
cagggtagaaccacggac

SEQ ID NO: 3951 - DNA, 22 bp, Homo sapiens
ttgtgaccagtcagaataatgt

SEQ ID NO: 3952 - DNA, 18 bp, Homo sapiens
tcactcctctcctcccgt

SEQ ID NO: 3953 - DNA, 21 bp, Homo sapiens
tccccagatacaatggacaat

SEQ ID NO: 3954 - DNA, 22 bp, Homo sapiens
tcgtgcatccctttagagtgtt

SEQ ID NO: 3955 - DNA, 18 bp, Homo sapiens
gctagataaccgaaagta

SEQ ID NO: 3956 - DNA, 23 bp, Homo sapiens
cctgtaacagcaactccatgtgg

SEQ ID NO: 3957 - DNA, 21 bp, Homo sapiens
gaaagtgcttccttttagagg

SEQ ID NO: 3958 - DNA, 17 bp, Homo sapiens
tatggcttttcattcct

SEQ ID NO: 3959 - DNA, 22 bp, Homo sapiens
tcagttccaggccaaccaggct

SEQ ID NO: 3960 - DNA, 25 bp, Homo sapiens
ttatggtttgcctgggactgaggaa

SEQ ID NO: 3961 - DNA, 19 bp, Homo sapiens
ttgtttgcagtcctctgtt

SEQ ID NO: 3962 - DNA, 18 bp, Homo sapiens
actcggcgtggcgtcggt

SEQ ID NO: 3963 - DNA, 22 bp, Homo sapiens
aaggcgcttccctttggagtgt

SEQ ID NO: 3964 - DNA, 23 bp, Homo sapiens
ttgtaaacatccccgactggaag

SEQ ID NO: 3965 - DNA, 20 bp, Homo sapiens
ctcaaactgtgggggcactt

SEQ ID NO: 3966 - DNA, 20 bp, Homo sapiens
tcgtacagggtcatccactt

SEQ ID NO: 3967 - DNA, 18 bp, Homo sapiens
taacagtctacagccatg

SEQ ID NO: 3968 - DNA, 20 bp, Homo sapiens
ctgcaaagggaagccctttc

SEQ ID NO: 3969 - DNA, 18 bp, Homo sapiens
gagcaataacgaaaaatg

SEQ ID NO: 3970 - DNA, 20 bp, Homo sapiens
cgcactgtgggtacttgctg

SEQ ID NO: 3971 - DNA, 17 bp, Homo sapiens
acaatctctactgaacc

SEQ ID NO: 3972 - DNA, 22 bp, Homo sapiens
cagcaccaggatattgttggag

SEQ ID NO: 3973 - DNA, 21 bp, Homo sapiens
gaaagcgcttccctttgctgg

SEQ ID NO: 3974 - DNA, 23 bp, Homo sapiens
gactccatttgttttgatgatgg

SEQ ID NO: 3975 - DNA, 22 bp, Homo sapiens
aaggcgcttccctttagagcgt

SEQ ID NO: 3976 - DNA, 23 bp, Homo sapiens
taacagtctccagtcacggccac

SEQ ID NO: 3977 - DNA, 23 bp, Homo sapiens
gatcgtgcatccctttagagtgt

SEQ ID NO: 3978 - DNA, 17 bp, Homo sapiens
actcggcgtggcgtcgg

SEQ ID NO: 3979 - DNA, 21 bp, Homo sapiens
cactgccccaggtgctgctgg

SEQ ID NO: 3980 - DNA, 20 bp, Homo sapiens
ttcaagtaatccaggatagg

SEQ ID NO: 3981 - DNA, 23 bp, Homo sapiens
gtaaacatcctacactctcagct

SEQ ID NO: 3982 - DNA, 19 bp, Homo sapiens
tttttcattattgctcctg

SEQ ID NO: 3983 - DNA, 19 bp, Homo sapiens
aagctgggttgagagggcg

SEQ ID NO: 3984 - DNA, 21 bp, Homo sapiens
tgtgactgcatgctcccaggt

SEQ ID NO: 3985 - DNA, 20 bp, Homo sapiens
aggttacccgagcaactttg

SEQ ID NO: 3986 - DNA, 24 bp, Homo sapiens
aaccgttaccattactgagtttag

SEQ ID NO: 3987 - DNA, 21 bp, Homo sapiens
acgcgcttccctatagagggt

SEQ ID NO: 3988 - DNA, 20 bp, Homo sapiens
ggtgcatctagtgcagatag

SEQ ID NO: 3989 - DNA, 20 bp, Homo sapiens
caacgaacctgagccactga

SEQ ID NO: 3990 - DNA, 18 bp, Homo sapiens
atgtttaggaccactaga

SEQ ID NO: 3991 - DNA, 20 bp, Homo sapiens
gatttcagtggagtgaagtt

SEQ ID NO: 3992 - DNA, 24 bp, Homo sapiens
gtcatacacggctctcctctcttt

SEQ ID NO: 3993 - DNA, 22 bp, Homo sapiens
ccagtgtttagactatctgttc

SEQ ID NO: 3994 - DNA, 19 bp, Homo sapiens
ataatacaacctgctaagt

SEQ ID NO: 3995 - DNA, 23 bp, Homo sapiens
tgctggatcagtggttcgagtct

SEQ ID NO: 3996 - DNA, 16 bp, Homo sapiens
gtaggttgtgtggttt

SEQ ID NO: 3997 - DNA, 20 bp, Homo sapiens
tgcactacagaactttgtct

SEQ ID NO: 3998 - DNA, 20 bp, Homo sapiens
aatcattcacggacaacact

SEQ ID NO: 3999 - DNA, 19 bp, Homo sapiens
ataaagctagataaccgaa

SEQ ID NO: 4000 - DNA, 20 bp, Homo sapiens
gcagcacatcatggtttaca

SEQ ID NO: 4001 - DNA, 16 bp, Homo sapiens
gatgaagcactgtagc

SEQ ID NO: 4002 - DNA, 21 bp, Homo sapiens
ctagcgtgtggtacttgaaga

SEQ ID NO: 4003 - DNA, 22 bp, Homo sapiens
gtgcaaatccatgcaaaactga

SEQ ID NO: 4004 - DNA, 19 bp, Homo sapiens
aaaagctgggttgagagga

SEQ ID NO: 4005 - DNA, 21 bp, Homo sapiens
aagtgcttccttttagagggt

SEQ ID NO: 4006 - DNA, 23 bp, Homo sapiens
aatccttgctatctgggtgctag

SEQ ID NO: 4007 - DNA, 30 bp, Homo sapiens
cgtgtatttgacaagctgagttggacactc

SEQ ID NO: 4008 - DNA, 20 bp, Homo sapiens
catccaggtctggggcatga

SEQ ID NO: 4009 - DNA, 25 bp, Homo sapiens
gtatggcactggtagaattcactgt

SEQ ID NO: 4010 - DNA, 19 bp, Homo sapiens
gtgaggtagtaggttgtat

SEQ ID NO: 4011 - DNA, 21 bp, Homo sapiens
cgtgtatttgacaagctgagt

SEQ ID NO: 4012 - DNA, 19 bp, Homo sapiens
acactggtgctctgtggga

SEQ ID NO: 4013 - DNA, 20 bp, Homo sapiens
gcaacgaacctgagccactg

SEQ ID NO: 4014 - DNA, 16 bp, Homo sapiens
agtggctaagttctgc

SEQ ID NO: 4015 - DNA, 24 bp, Homo sapiens
catgccttgagtgtaggaccgttg

SEQ ID NO: 4016 - DNA, 21 bp, Homo sapiens
ttcctgctgaactgagccagt

SEQ ID NO: 4017 - DNA, 20 bp, Homo sapiens
aaaatggttccctttagagt

SEQ ID NO: 4018 - DNA, 18 bp, Homo sapiens
ggaatcccaaaagcagct

SEQ ID NO: 4019 - DNA, 20 bp, Homo sapiens
ataatacatggttgatcttt

SEQ ID NO: 4020 - DNA, 22 bp, Homo sapiens
ctgtaacttggaactggagagg

SEQ ID NO: 4021 - DNA, 18 bp, Homo sapiens
ctagtgattttgttgttg

SEQ ID NO: 4022 - DNA, 17 bp, Homo sapiens
ggtagtaggttgtgtgg

SEQ ID NO: 4023 - DNA, 20 bp, Homo sapiens
ctggtttcacatggtggctt

SEQ ID NO: 4024 - DNA, 20 bp, Homo sapiens
ctccgtttgcctgtttcgct

SEQ ID NO: 4025 - DNA, 21 bp, Homo sapiens
gcaatggtagaactcacactg

SEQ ID NO: 4026 - DNA, 21 bp, Homo sapiens
cattcattgctgtcggtgggt

SEQ ID NO: 4027 - DNA, 19 bp, Homo sapiens
cactcctctcctcccgtct

SEQ ID NO: 4028 - DNA, 24 bp, Homo sapiens
cagacaatccatgtgcttctcttg

SEQ ID NO: 4029 - DNA, 18 bp, Homo sapiens
ctgaattccataggctgt

SEQ ID NO: 4030 - DNA, 26 bp, Homo sapiens
tgaggtagtagattgtatagttgtgg

SEQ ID NO: 4031 - DNA, 19 bp, Homo sapiens
tgctaatcgtgataggggt

SEQ ID NO: 4032 - DNA, 26 bp, Homo sapiens
agacgggaggaaagaagggagtggtt

SEQ ID NO: 4033 - DNA, 23 bp, Homo sapiens
tcttctctgttttggccatgtgt

SEQ ID NO: 4034 - DNA, 20 bp, Homo sapiens
tggcaatggtagaactcaca

SEQ ID NO: 4035 - DNA, 21 bp, Homo sapiens
gtgcaaatccatgcaaaactg

SEQ ID NO: 4036 - DNA, 22 bp, Homo sapiens
atcaaggatcttaaactttgcc

SEQ ID NO: 4037 - DNA, 21 bp, Homo sapiens
tacagttgttcaaccagttac

SEQ ID NO: 4038 - DNA, 22 bp, Homo sapiens
catctggaggtaagaagcactt

SEQ ID NO: 4039 - DNA, 17 bp, Homo sapiens
atggcactggtagaatt

SEQ ID NO: 4040 - DNA, 18 bp, Homo sapiens
actggtagaattcactgt

SEQ ID NO: 4041 - DNA, 23 bp, Homo sapiens
gaacatccaggtctggggcatga

SEQ ID NO: 4042 - DNA, 23 bp, Homo sapiens
ccctgagaccctttaacctgtga

SEQ ID NO: 4043 - DNA, 21 bp, Homo sapiens
tggcaatggtagaactcacac

SEQ ID NO: 4044 - DNA, 22 bp, Homo sapiens
tggcaatggtagaactcacact

SEQ ID NO: 4045 - DNA, 21 bp, Homo sapiens
cctgtgcctggcctgaggagc

SEQ ID NO: 4046 - DNA, 22 bp, Homo sapiens
agctggtgttgtgaatcaggcc

SEQ ID NO: 4047 - DNA, 20 bp, Homo sapiens
gagtgccttcttttggagcg

SEQ ID NO: 4048 - DNA, 20 bp, Homo sapiens
accgcactgtgggtacttgc

SEQ ID NO: 4049 - DNA, 23 bp, Homo sapiens
atcttaccggacagtgctggatt

SEQ ID NO: 4050 - DNA, 27 bp, Homo sapiens
ttaatgctaatcgtgataggggttttt

SEQ ID NO: 4051 - DNA, 18 bp, Homo sapiens
ctcgtaccgtgagtaata

SEQ ID NO: 4052 - DNA, 21 bp, Homo sapiens
caagaacctcagttgcttttg

SEQ ID NO: 4053 - DNA, 19 bp, Homo sapiens
ttggtacgtctgtgggtag

SEQ ID NO: 4054 - DNA, 25 bp, Homo sapiens
aggcagtgtattgttagctggctgc

SEQ ID NO: 4055 - DNA, 20 bp, Homo sapiens
aaacatggttccgtcaagca

SEQ ID NO: 4056 - DNA, 21 bp, Homo sapiens
tggtttcacatggtggcttag

SEQ ID NO: 4057 - DNA, 26 bp, Homo sapiens
tgagaactgaattccataggctgtga

SEQ ID NO: 4058 - DNA, 22 bp, Homo sapiens
gcaacaccagtcgatgggctgt

SEQ ID NO: 4059 - DNA, 19 bp, Homo sapiens
agcaccatctgaaatcggt

SEQ ID NO: 4060 - DNA, 20 bp, Homo sapiens
ttcattccaccggagtctgt

SEQ ID NO: 4061 - DNA, 24 bp, Homo sapiens
ataccctgtagaaccgaatttgtg

SEQ ID NO: 4062 - DNA, 22 bp, Homo sapiens
ttgtaactggttgaacaactga

SEQ ID NO: 4063 - DNA, 21 bp, Homo sapiens
agaagatctcaggctgtgacc

SEQ ID NO: 4064 - DNA, 22 bp, Homo sapiens
tcgtgcatccttttagagtgtt

SEQ ID NO: 4065 - DNA, 19 bp, Homo sapiens
ccagaactggtcggtgatt

SEQ ID NO: 4066 - DNA, 23 bp, Homo sapiens
atcatagaggaaaatccatgttt

SEQ ID NO: 4067 - DNA, 22 bp, Homo sapiens
agtgctctcgtctcccctctgg

SEQ ID NO: 4068 - DNA, 20 bp, Homo sapiens
ctgtgggccacctagtcacc

SEQ ID NO: 4069 - DNA, 19 bp, Homo sapiens
gcagcaattcatgttttga

SEQ ID NO: 4070 - DNA, 19 bp, Homo sapiens
actgcctggtaatgatgac

SEQ ID NO: 4071 - DNA, 17 bp, Homo sapiens
attgtacagggctatga

SEQ ID NO: 4072 - DNA, 21 bp, Homo sapiens
gctctgacgaggttgcactac

SEQ ID NO: 4073 - DNA, 22 bp, Homo sapiens
ttgtttaaccttttgcctgttg

SEQ ID NO: 4074 - DNA, 19 bp, Homo sapiens
ctgagaccctaacttgtga

SEQ ID NO: 4075 - DNA, 19 bp, Homo sapiens
agtgctgttcgtgcaggta

SEQ ID NO: 4076 - DNA, 20 bp, Homo sapiens
attattacttttggtacgcg

SEQ ID NO: 4077 - DNA, 22 bp, Homo sapiens
ctgggtggtctggagatttgtg

SEQ ID NO: 4078 - DNA, 26 bp, Homo sapiens
catggcaacaccagtcgatgggctgt

SEQ ID NO: 4079 - DNA, 15 bp, Homo sapiens
cttgtctcggtctga

SEQ ID NO: 4080 - DNA, 21 bp, Homo sapiens
ctacattgtctgctgggtttc

SEQ ID NO: 4081 - DNA, 21 bp, Homo sapiens
acagtactgtgataactgaag

SEQ ID NO: 4082 - DNA, 23 bp, Homo sapiens
gaccgatttctcctggtgttcag

SEQ ID NO: 4083 - DNA, 22 bp, Homo sapiens
ctctgacctatgaattgacagc

SEQ ID NO: 4084 - DNA, 22 bp, Homo sapiens
aaagctagataaccgaaagtag

SEQ ID NO: 4085 - DNA, 26 bp, Homo sapiens
aatcctttgtccctgggtgagagtgc

SEQ ID NO: 4086 - DNA, 23 bp, Homo sapiens
agaggttgcccttggtgaattcg

SEQ ID NO: 4087 - DNA, 23 bp, Homo sapiens
ttggggaaacggccgctgagtga

SEQ ID NO: 4088 - DNA, 18 bp, Homo sapiens
gtagtaggttgtatggtt

SEQ ID NO: 4089 - DNA, 29 bp, Homo sapiens
acagcactagattgtaaagactggggtgg

SEQ ID NO: 4090 - DNA, 21 bp, Homo sapiens
taaacatccccgactggaagc

SEQ ID NO: 4091 - DNA, 20 bp, Homo sapiens
agaagatctcaggctgtcgt

SEQ ID NO: 4092 - DNA, 23 bp, Homo sapiens
gctgaagctcagagggctctgat

SEQ ID NO: 4093 - DNA, 20 bp, Homo sapiens
ggtccagttttcccaggaat

SEQ ID NO: 4094 - DNA, 22 bp, Homo sapiens
ctgctgagctagcacttcccga

SEQ ID NO: 4095 - DNA, 22 bp, Homo sapiens
acaggcggctgtagcaatgggg

SEQ ID NO: 4096 - DNA, 22 bp, Homo sapiens
ctgtacaggccactgccttgcc

SEQ ID NO: 4097 - DNA, 27 bp, Homo sapiens
tatggcactggtagaattcactgtgaa

SEQ ID NO: 4098 - DNA, 19 bp, Homo sapiens
actctagctgccaaaggcg

SEQ ID NO: 4099 - DNA, 23 bp, Homo sapiens
aggacaatgccgttgtacagtag

SEQ ID NO: 4100 - DNA, 22 bp, Homo sapiens
gtagattctccttctatgagta

SEQ ID NO: 4101 - DNA, 19 bp, Homo sapiens
ctcctggcgggcagctgtg

SEQ ID NO: 4102 - DNA, 23 bp, Homo sapiens
ttggagtaggtcattgggtggat

SEQ ID NO: 4103 - DNA, 21 bp, Homo sapiens
ctggagatatggaagagctgt

SEQ ID NO: 4104 - DNA, 22 bp, Homo sapiens
gtaaacatccccgactggaagc

SEQ ID NO: 4105 - DNA, 29 bp, Homo sapiens
gctcatgatgagcaaactgagcctctaag

SEQ ID NO: 4106 - DNA, 26 bp, Homo sapiens
aaagttctgagacactccgactctga

SEQ ID NO: 4107 - DNA, 22 bp, Homo sapiens
aaaactgtaattacttttggac

SEQ ID NO: 4108 - DNA, 27 bp, Homo sapiens
catggcaacaccagtcgatgggctgtc

SEQ ID NO: 4109 - DNA, 18 bp, Homo sapiens
cctgtagatccgaatttg

SEQ ID NO: 4110 - DNA, 20 bp, Homo sapiens
ctccagagggaagcgctttc

SEQ ID NO: 4111 - DNA, 21 bp, Homo sapiens
gctgattcctgggctctgacc

SEQ ID NO: 4112 - DNA, 22 bp, Homo sapiens
gcaccagaactggtcggtgatt

SEQ ID NO: 4113 - DNA, 18 bp, Homo sapiens
acctggcatacaatgtag

SEQ ID NO: 4114 - DNA, 21 bp, Homo sapiens
cctctaagaagttgactgaag

SEQ ID NO: 4115 - DNA, 21 bp, Homo sapiens
caccagaactggtcggtgatt

SEQ ID NO: 4116 - DNA, 18 bp, Homo sapiens
tcagtcggatgtttgcag

SEQ ID NO: 4117 - DNA, 22 bp, Homo sapiens
ccaatattactgtgctgcttta

SEQ ID NO: 4118 - DNA, 18 bp, Homo sapiens
ttacagttgttcaaccag

SEQ ID NO: 4119 - DNA, 21 bp, Homo sapiens
cagtgcatgacagaacttggg

SEQ ID NO: 4120 - DNA, 22 bp, Homo sapiens
ctcagtctcatctgcaaagaag

SEQ ID NO: 4121 - DNA, 19 bp, Homo sapiens
ctgccaattccataggtca

SEQ ID NO: 4122 - DNA, 22 bp, Homo sapiens
tgattgtccaaacgcaattctc

SEQ ID NO: 4123 - DNA, 24 bp, Homo sapiens
ccatctggaggtaagaagcacttt

SEQ ID NO: 4124 - DNA, 21 bp, Homo sapiens
aatcactaactccactgccat

SEQ ID NO: 4125 - DNA, 21 bp, Homo sapiens
aaagaattctccttttgggct

SEQ ID NO: 4126 - DNA, 21 bp, Homo sapiens
aatggtgccctagtgactaca

SEQ ID NO: 4127 - DNA, 21 bp, Homo sapiens
tgtcttactccctcaggcaca

SEQ ID NO: 4128 - DNA, 24 bp, Homo sapiens
atctggaggtaagaagcactttgt

SEQ ID NO: 4129 - DNA, 22 bp, Homo sapiens
cagagaacaaaggactcagtaa

SEQ ID NO: 4130 - DNA, 21 bp, Homo sapiens
gcagagaacaaaggactcagt

SEQ ID NO: 4131 - DNA, 21 bp, Homo sapiens
tgtgatatcatggttcctggg

SEQ ID NO: 4132 - DNA, 19 bp, Homo sapiens
tcagttccaggccaaccag

SEQ ID NO: 4133 - DNA, 21 bp, Homo sapiens
acatccaggtctggggcatga

SEQ ID NO: 4134 - DNA, 19 bp, Homo sapiens
agcattgtacagggctatg

SEQ ID NO: 4135 - DNA, 21 bp, Homo sapiens
ctcaagatggaagcagtttct

SEQ ID NO: 4136 - DNA, 23 bp, Homo sapiens
gtcatacacggctctcctctctt

SEQ ID NO: 4137 - DNA, 30 bp, Homo sapiens
tttggcaatggtagaactcacactggtgag

SEQ ID NO: 4138 - DNA, 22 bp, Homo sapiens
gtagattttccttctatggtta

SEQ ID NO: 4139 - DNA, 20 bp, Homo sapiens
caagtcactagtggttccgt

SEQ ID NO: 4140 - DNA, 20 bp, Homo sapiens
acgggttaggctcttgggag

SEQ ID NO: 4141 - DNA, 21 bp, Homo sapiens
cctgtactgagctgccccgag

SEQ ID NO: 4142 - DNA, 17 bp, Homo sapiens
caagctcgtgtctgtgg

SEQ ID NO: 4143 - DNA, 19 bp, Homo sapiens
acctggcatacaatgtaga

SEQ ID NO: 4144 - DNA, 23 bp, Homo sapiens
aagtcattggagggtttgagcag

SEQ ID NO: 4145 - DNA, 16 bp, Homo sapiens
accacagggtagaacc

SEQ ID NO: 4146 - DNA, 26 bp, Homo sapiens
taccctgtagatccgaatttgtgtaa

SEQ ID NO: 4147 - DNA, 18 bp, Homo sapiens
ttgttgcgctcctctcag

SEQ ID NO: 4148 - DNA, 20 bp, Homo sapiens
cattgttgcgctcctctcag

SEQ ID NO: 4149 - DNA, 22 bp, Homo sapiens
aacatccaggtctggggcatga

SEQ ID NO: 4150 - DNA, 23 bp, Homo sapiens
acccgtagatccgaacttgtggt

SEQ ID NO: 4151 - DNA, 22 bp, Homo sapiens
acccgtagatccgaacttgtgg

SEQ ID NO: 4152 - DNA, 21 bp, Homo sapiens
gtggttatccctgctgtgttc

SEQ ID NO: 4153 - DNA, 18 bp, Homo sapiens
actgaattccataggctg

SEQ ID NO: 4154 - DNA, 19 bp, Homo sapiens
tggcagtgtcttagctggt

SEQ ID NO: 4155 - DNA, 22 bp, Homo sapiens
ctgtgaaactgggctcaaggtg

SEQ ID NO: 4156 - DNA, 20 bp, Homo sapiens
ccagtgttcagactacctgt

SEQ ID NO: 4157 - DNA, 19 bp, Homo sapiens
tgtatggcactggtagaat

SEQ ID NO: 4158 - DNA, 23 bp, Homo sapiens
ctctcaccactgccctcccacag

SEQ ID NO: 4159 - DNA, 18 bp, Homo sapiens
tactgccgggtaatgatg

SEQ ID NO: 4160 - DNA, 20 bp, Homo sapiens
cctcctggcgggcagctgtg

SEQ ID NO: 4161 - DNA, 19 bp, Homo sapiens
acatcctacactctcagct

SEQ ID NO: 4162 - DNA, 24 bp, Homo sapiens
ctctgacctatgaattgacagcca

SEQ ID NO: 4163 - DNA, 23 bp, Homo sapiens
ctctgacctatgaattgacagcc

SEQ ID NO: 4164 - DNA, 19 bp, Homo sapiens
cacagggtagaaccacgga

SEQ ID NO: 4165 - DNA, 22 bp, Homo sapiens
ctgataagaacagaggcccaga

SEQ ID NO: 4166 - DNA, 23 bp, Homo sapiens
tattgcttaagaatacgcgtagt

SEQ ID NO: 4167 - DNA, 19 bp, Homo sapiens
gacctatgaattgacagac

SEQ ID NO: 4168 - DNA, 20 bp, Homo sapiens
taaacatcctacactcagct

SEQ ID NO: 4169 - DNA, 20 bp, Homo sapiens
caccatttgaaatcagtgtt

SEQ ID NO: 4170 - DNA, 17 bp, Homo sapiens
tagtaggttgtatagtt

SEQ ID NO: 4171 - DNA, 23 bp, Homo sapiens
agtgcacccaggcaaggattctg

SEQ ID NO: 4172 - DNA, 23 bp, Homo sapiens
cgtgttcacagcggaccttgatt

SEQ ID NO: 4173 - DNA, 16 bp, Homo sapiens
cagcaactccatgtgg

SEQ ID NO: 4174 - DNA, 22 bp, Homo sapiens
gtgagtctctaagaaaagagga

SEQ ID NO: 4175 - DNA, 21 bp, Homo sapiens
ttgtgaccagtcagaataatg

SEQ ID NO: 4176 - DNA, 20 bp, Homo sapiens
gtgaccagtcagaataatgt

SEQ ID NO: 4177 - DNA, 26 bp, Homo sapiens
aggcagtgtattgttagctggctgct

SEQ ID NO: 4178 - DNA, 19 bp, Homo sapiens
gtgcattgtagttgcattg

SEQ ID NO: 4179 - DNA, 26 bp, Homo sapiens
ctcagacaatccatgtgcttctcttg

SEQ ID NO: 4180 - DNA, 19 bp, Homo sapiens
ttcagtcggatgtttacag

SEQ ID NO: 4181 - DNA, 20 bp, Homo sapiens
ctgtcggccggccctgggtc

SEQ ID NO: 4182 - DNA, 23 bp, Homo sapiens
gcaacaccagtcgatgggctgtc

SEQ ID NO: 4183 - DNA, 23 bp, Homo sapiens
catatgtctgctgaccatcacct

SEQ ID NO: 4184 - DNA, 20 bp, Homo sapiens
taaacatccttgactggaag

SEQ ID NO: 4185 - DNA, 20 bp, Homo sapiens
gacctatgaattgacagaca

SEQ ID NO: 4186 - DNA, 21 bp, Homo sapiens
ttgaggtagtaggttgtatag

SEQ ID NO: 4187 - DNA, 22 bp, Homo sapiens
tggcgtccccttccccgccggc

SEQ ID NO: 4188 - DNA, 19 bp, Homo sapiens
agcgctcccctttagaggt

SEQ ID NO: 4189 - DNA, 27 bp, Homo sapiens
aaagttctgagacactccgactctgag

SEQ ID NO: 4190 - DNA, 22 bp, Homo sapiens
gctgcgcttggatttcgtcccc

SEQ ID NO: 4191 - DNA, 23 bp, Homo sapiens
tgtaaacatcctcgactggaagc

SEQ ID NO: 4192 - DNA, 23 bp, Homo sapiens
gctctgacctatgaattgacagc

SEQ ID NO: 4193 - DNA, 20 bp, Homo sapiens
gccttcagaggactccaagg

SEQ ID NO: 4194 - DNA, 23 bp, Homo sapiens
aaaactgtaattacttttggacc

SEQ ID NO: 4195 - DNA, 22 bp, Homo sapiens
tcgtaccgtgagtaataatgcg

SEQ ID NO: 4196 - DNA, 20 bp, Homo sapiens
cagttaccgcttccgctacc

SEQ ID NO: 4197 - DNA, 21 bp, Homo sapiens
atgcaccatggttgtctgagc

SEQ ID NO: 4198 - DNA, 23 bp, Homo sapiens
catctgatatacaatattttctt

SEQ ID NO: 4199 - DNA, 23 bp, Homo sapiens
agaattgtggctggacatctgtg

SEQ ID NO: 4200 - DNA, 18 bp, Homo sapiens
taactggttgaacaactg

SEQ ID NO: 4201 - DNA, 23 bp, Homo sapiens
agtggttcttaacagttcaacag

SEQ ID NO: 4202 - DNA, 22 bp, Homo sapiens
agtcatacacggctctcctctc

SEQ ID NO: 4203 - DNA, 22 bp, Homo sapiens
ttaggccgcagatctgggtgaa

SEQ ID NO: 4204 - DNA, 22 bp, Homo sapiens
actgcattatgagcacttaaag

SEQ ID NO: 4205 - DNA, 20 bp, Homo sapiens
catcatcgtctcaaatgagt

SEQ ID NO: 4206 - DNA, 20 bp, Homo sapiens
tcatcgtctcaaatgagtct

SEQ ID NO: 4207 - DNA, 18 bp, Homo sapiens
cttatcagattgtattgt

SEQ ID NO: 4208 - DNA, 21 bp, Homo sapiens
ctatacaacttactactttcc

SEQ ID NO: 4209 - DNA, 19 bp, Homo sapiens
tacagcaggcacagacagg

SEQ ID NO: 4210 - DNA, 19 bp, Homo sapiens
ccataaagtagaaagcact

SEQ ID NO: 4211 - DNA, 20 bp, Homo sapiens
cgcatcccctagggcattgg

SEQ ID NO: 4212 - DNA, 20 bp, Homo sapiens
acaaagtgcttccctttaga

SEQ ID NO: 4213 - DNA, 24 bp, Homo sapiens
tcgaggactggtggaagggccttt

SEQ ID NO: 4214 - DNA, 18 bp, Homo sapiens
gtagtagtttgtacagtt

SEQ ID NO: 4215 - DNA, 21 bp, Homo sapiens
tttgataagctgacatgggac

SEQ ID NO: 4216 - DNA, 23 bp, Homo sapiens
tggtgggccgcagaacatgtgct

SEQ ID NO: 4217 - DNA, 17 bp, Homo sapiens
ggttatctagctgtatg

SEQ ID NO: 4218 - DNA, 17 bp, Homo sapiens
gcccctgggcctatcct

SEQ ID NO: 4219 - DNA, 23 bp, Homo sapiens
tgtcttgcaggccgtcatgcagg

SEQ ID NO: 4220 - DNA, 20 bp, Homo sapiens
tcaccagccctgtgttccct

SEQ ID NO: 4221 - DNA, 19 bp, Homo sapiens
aaatggtgccctagtgact

SEQ ID NO: 4222 - DNA, 21 bp, Homo sapiens
gtagattttccttctatggtt

SEQ ID NO: 4223 - DNA, 23 bp, Homo sapiens
tctttcgggccgtagagccaggg

SEQ ID NO: 4224 - DNA, 21 bp, Homo sapiens
tcaacacttgctggtttcctc

SEQ ID NO: 4225 - DNA, 22 bp, Homo sapiens
tcaccaccttctccacccagca

SEQ ID NO: 4226 - DNA, 27 bp, Homo sapiens
cgtgtatttgacaagctgagttggaca

SEQ ID NO: 4227 - DNA, 22 bp, Homo sapiens
gtatgtgggatggtaaaccgct

SEQ ID NO: 4228 - DNA, 21 bp, Homo sapiens
catcgtctcaaatgagtcttc

SEQ ID NO: 4229 - DNA, 20 bp, Homo sapiens
tatgtaacatggtccactaa

SEQ ID NO: 4230 - DNA, 21 bp, Homo sapiens
cccttgggtctgatggggtag

SEQ ID NO: 4231 - DNA, 22 bp, Homo sapiens
agagtctccagtaatggacggg

SEQ ID NO: 4232 - DNA, 19 bp, Homo sapiens
ttcacagggaggtgtcatt

SEQ ID NO: 4233 - DNA, 19 bp, Homo sapiens
gcttttcattcctatgtga

SEQ ID NO: 4234 - DNA, 23 bp, Homo sapiens
gaaggcgcttccctttggagtgt

SEQ ID NO: 4235 - DNA, 21 bp, Homo sapiens
cccccaggtgtgattctgatt

SEQ ID NO: 4236 - DNA, 22 bp, Homo sapiens
tggagttaggattaggtcgtgg

SEQ ID NO: 4237 - DNA, 20 bp, Homo sapiens
caatcactaactccactgcc

SEQ ID NO: 4238 - DNA, 18 bp, Homo sapiens
cgtagatccgatcttgtg

SEQ ID NO: 4239 - DNA, 22 bp, Homo sapiens
tgagcgcctcgacgacagagcc

SEQ ID NO: 4240 - DNA, 18 bp, Homo sapiens
agatctcaggttgtgacc

SEQ ID NO: 4241 - DNA, 20 bp, Homo sapiens
agcaccatttgaaatcggtt

SEQ ID NO: 4242 - DNA, 22 bp, Homo sapiens
cattcattgctgtcggtgggtt

SEQ ID NO: 4243 - DNA, 24 bp, Homo sapiens
tgtcactcggctcggcccactacc

SEQ ID NO: 4244 - DNA, 20 bp, Homo sapiens
aaagtgcttccttttagagg

SEQ ID NO: 4245 - DNA, 15 bp, Homo sapiens
aacccgtagatccga

SEQ ID NO: 4246 - DNA, 19 bp, Homo sapiens
aacaccagtcgatgggctg

SEQ ID NO: 4247 - DNA, 22 bp, Homo sapiens
aaagaattctccttttgggctt

SEQ ID NO: 4248 - DNA, 19 bp, Homo sapiens
taaacatcctcgactggaa

SEQ ID NO: 4249 - DNA, 20 bp, Homo sapiens
ttctcaagagggaggcaatc

SEQ ID NO: 4250 - DNA, 23 bp, Homo sapiens
gacgggaggaaagaagggagtgg

SEQ ID NO: 4251 - DNA, 20 bp, Homo sapiens
ctcagtctcatctgcaaaga

SEQ ID NO: 4252 - DNA, 21 bp, Homo sapiens
aggcgttcgtgcgacgtgtgg

SEQ ID NO: 4253 - DNA, 22 bp, Homo sapiens
ctctagatggaagcactgtctg

SEQ ID NO: 4254 - DNA, 22 bp, Homo sapiens
ctgaggtaggaggttgtatagt

SEQ ID NO: 4255 - DNA, 24 bp, Homo sapiens
tataccctgtagatccgaatttgt

SEQ ID NO: 4256 - DNA, 23 bp, Homo sapiens
tataccctgtagatccgaatttg

SEQ ID NO: 4257 - DNA, 24 bp, Homo sapiens
atataccctgtagatccgaatttg

SEQ ID NO: 4258 - DNA, 23 bp, Homo sapiens
atataccctgtagatccgaattt

SEQ ID NO: 4259 - DNA, 25 bp, Homo sapiens
atataccctgtagatccgaatttgt

SEQ ID NO: 4260 - DNA, 21 bp, Homo sapiens
agaagatgtcaggctgtgacc

SEQ ID NO: 4261 - DNA, 20 bp, Homo sapiens
aggtagtaggttgcatagtt

SEQ ID NO: 4262 - DNA, 21 bp, Homo sapiens
attgcactcgtcccggcctcc

SEQ ID NO: 4263 - DNA, 19 bp, Homo sapiens
ttctcaaggaggtgtcgtt

SEQ ID NO: 4264 - DNA, 18 bp, Homo sapiens
gcaccatctgaaatcggt

SEQ ID NO: 4265 - DNA, 23 bp, Homo sapiens
gctcctatatgatgcctttcttc

SEQ ID NO: 4266 - DNA, 20 bp, Homo sapiens
tgttgtacttttttttttgt

SEQ ID NO: 4267 - DNA, 20 bp, Homo sapiens
gaagatctcatgctgtgact

SEQ ID NO: 4268 - DNA, 20 bp, Homo sapiens
actcaaaatgggggcgcttt

SEQ ID NO: 4269 - DNA, 21 bp, Homo sapiens
tcagtctcatctgcaaagaag

SEQ ID NO: 4270 - DNA, 20 bp, Homo sapiens
aatcactaactccactgcca

SEQ ID NO: 4271 - DNA, 18 bp, Homo sapiens
ccgtagaaccgaccttgc

SEQ ID NO: 4272 - DNA, 19 bp, Homo sapiens
gtagcttatcagactgatg

SEQ ID NO: 4273 - DNA, 22 bp, Homo sapiens
tgtaaacatcctcgactggaag

SEQ ID NO: 4274 - DNA, 22 bp, Homo sapiens
tctggaggtaagaagcactttc

SEQ ID NO: 4275 - DNA, 21 bp, Homo sapiens
tctggaggtaagaagcacttt

SEQ ID NO: 4276 - DNA, 19 bp, Homo sapiens
gtcatttttgtgatgttgc

SEQ ID NO: 4277 - DNA, 23 bp, Homo sapiens
gaagttctgttatacactcaggc

SEQ ID NO: 4278 - DNA, 20 bp, Homo sapiens
gaggtagtaggttgtatggt

SEQ ID NO: 4279 - DNA, 20 bp, Homo sapiens
actgctgagctagcacttcc

SEQ ID NO: 4280 - DNA, 21 bp, Homo sapiens
aaactgtaattacttttggac

SEQ ID NO: 4281 - DNA, 18 bp, Homo sapiens
ctaagaagttgactgaag

SEQ ID NO: 4282 - DNA, 22 bp, Homo sapiens
tatgtaacacggtccactaacc

SEQ ID NO: 4283 - DNA, 19 bp, Homo sapiens
tgattgacacttctgtgag

SEQ ID NO: 4284 - DNA, 18 bp, Homo sapiens
agtaatccaggataggct

SEQ ID NO: 4285 - DNA, 20 bp, Homo sapiens
cctgctggggtggaacctgg

SEQ ID NO: 4286 - DNA, 20 bp, Homo sapiens
agtgccgccatcttttgagt

SEQ ID NO: 4287 - DNA, 20 bp, Homo sapiens
aaacaaacatggtgcacttc

SEQ ID NO: 4288 - DNA, 19 bp, Homo sapiens
gaagatctcaggcagtgac

SEQ ID NO: 4289 - DNA, 22 bp, Homo sapiens
catacaaggacaatttcttttt

SEQ ID NO: 4290 - DNA, 19 bp, Homo sapiens
cagtactgtgataactgaa

SEQ ID NO: 4291 - DNA, 20 bp, Homo sapiens
agtgcatccttttagagtgt

SEQ ID NO: 4292 - DNA, 21 bp, Homo sapiens
atcatacaaggacaatttctt

SEQ ID NO: 4293 - DNA, 21 bp, Homo sapiens
caagtcaggctcttgggacct

SEQ ID NO: 4294 - DNA, 18 bp, Homo sapiens
cgtagaaccgaccttgcg

SEQ ID NO: 4295 - DNA, 24 bp, Homo sapiens
gagcctctaagaagttgactgaag

SEQ ID NO: 4296 - DNA, 17 bp, Homo sapiens
tgtagaaccgaatttgt

SEQ ID NO: 4297 - DNA, 22 bp, Homo sapiens
caacaaatcccagtctacctaa

SEQ ID NO: 4298 - DNA, 25 bp, Homo sapiens
aaagttctgagacactccgactctg

SEQ ID NO: 4299 - DNA, 22 bp, Homo sapiens
attgtccttgctgtttggagat

SEQ ID NO: 4300 - DNA, 20 bp, Homo sapiens
aacattcattgttgtcggtg

SEQ ID NO: 4301 - DNA, 21 bp, Homo sapiens
cagcaccaggatattgttgga

SEQ ID NO: 4302 - DNA, 22 bp, Homo sapiens
ctgggtttacgttgggagaact

SEQ ID NO: 4303 - DNA, 23 bp, Homo sapiens
gatcatgatgggctcctcggtgt

SEQ ID NO: 4304 - DNA, 22 bp, Homo sapiens
agctacagttacttttgcacca

SEQ ID NO: 4305 - DNA, 22 bp, Homo sapiens
ctgtcctaaggttgttgagttg

SEQ ID NO: 4306 - DNA, 24 bp, Homo sapiens
ctctttggttatctagctgtatga

SEQ ID NO: 4307 - DNA, 23 bp, Homo sapiens
ttcacaaggaggtgtcatttatg

SEQ ID NO: 4308 - DNA, 17 bp, Homo sapiens
tgattgtagccttttgg

SEQ ID NO: 4309 - DNA, 18 bp, Homo sapiens
gtgtttcctactttatgg

SEQ ID NO: 4310 - DNA, 21 bp, Homo sapiens
ctcagccttgagggcactttc

SEQ ID NO: 4311 - DNA, 16 bp, Homo sapiens
gtaggttgtatagttt

SEQ ID NO: 4312 - DNA, 18 bp, Homo sapiens
ggtagtaggttgtgtggt

SEQ ID NO: 4313 - DNA, 21 bp, Homo sapiens
gtgtgactggttgaccagagg

SEQ ID NO: 4314 - DNA, 20 bp, Homo sapiens
ctgagctgactatgcctccc

SEQ ID NO: 4315 - DNA, 20 bp, Homo sapiens
tggtgggccgcagaacatgt

SEQ ID NO: 4316 - DNA, 21 bp, Homo sapiens
agacgggaggaaagaagggag

SEQ ID NO: 4317 - DNA, 22 bp, Homo sapiens
tgtccttgctgtttggagataa

SEQ ID NO: 4318 - DNA, 20 bp, Homo sapiens
agaggttgcccttggtgaat

SEQ ID NO: 4319 - DNA, 19 bp, Homo sapiens
aaggagctcacagtctatt

SEQ ID NO: 4320 - DNA, 18 bp, Homo sapiens
ttggttatctagctgtat

SEQ ID NO: 4321 - DNA, 24 bp, Homo sapiens
tagcaccatctgaaatcggttata

SEQ ID NO: 4322 - DNA, 18 bp, Homo sapiens
acaagtcaggctcttggg

SEQ ID NO: 4323 - DNA, 23 bp, Homo sapiens
gtggcgtccccttccccgccggc

SEQ ID NO: 4324 - DNA, 20 bp, Homo sapiens
cctggactgagccgtgctac

SEQ ID NO: 4325 - DNA, 21 bp, Homo sapiens
aaaagctgggttgagagggca

SEQ ID NO: 4326 - DNA, 24 bp, Homo sapiens
cgtggcgtccccttccccgccggc

SEQ ID NO: 4327 - DNA, 23 bp, Homo sapiens
tctggaggtaagaagcactttct

SEQ ID NO: 4328 - DNA, 23 bp, Homo sapiens
cctcctgccctccttgctgtaga

SEQ ID NO: 4329 - DNA, 20 bp, Homo sapiens
aacactgtctggtaaagatg

SEQ ID NO: 4330 - DNA, 20 bp, Homo sapiens
tacagtactgtgataactga

SEQ ID NO: 4331 - DNA, 20 bp, Homo sapiens
tgtgatatcatggttcctgg

SEQ ID NO: 4332 - DNA, 16 bp, Homo sapiens
catcctcgactggaag

SEQ ID NO: 4333 - DNA, 21 bp, Homo sapiens
cctcaaatgtggagcactatt

SEQ ID NO: 4334 - DNA, 23 bp, Homo sapiens
tactgcagacgtggcaatcatgt

SEQ ID NO: 4335 - DNA, 21 bp, Homo sapiens
agcagcaattcatgttttgaa

SEQ ID NO: 4336 - DNA, 30 bp, Homo sapiens
actgctagctgtagaactccagcttcggcc

SEQ ID NO: 4337 - DNA, 21 bp, Homo sapiens
tcttaccggacagtgctggat

SEQ ID NO: 4338 - DNA, 25 bp, Homo sapiens
tacccattgcatatcggagttgtga

SEQ ID NO: 4339 - DNA, 22 bp, Homo sapiens
ctctcaccactgccctcccaca

SEQ ID NO: 4340 - DNA, 23 bp, Homo sapiens
ttaaggcacgcggtgaatgccaa

SEQ ID NO: 4341 - DNA, 21 bp, Homo sapiens
aactgtaattacttttggacc

SEQ ID NO: 4342 - DNA, 25 bp, Homo sapiens
tgtatggcactggtagaattcactg

SEQ ID NO: 4343 - DNA, 23 bp, Homo sapiens
ctgagacctctgggttctgagct

SEQ ID NO: 4344 - DNA, 18 bp, Homo sapiens
aactggttgaacaactga

SEQ ID NO: 4345 - DNA, 24 bp, Homo sapiens
ttggggaaacggccgctgagtgag

SEQ ID NO: 4346 - DNA, 22 bp, Homo sapiens
cgagcctcaagcaagggacttc

SEQ ID NO: 4347 - DNA, 20 bp, Homo sapiens
tagcagcgggaacagttctg

SEQ ID NO: 4348 - DNA, 23 bp, Homo sapiens
tgtaaacatcctacactcagctg

SEQ ID NO: 4349 - DNA, 22 bp, Homo sapiens
cctccaaagggaagcgctttct

SEQ ID NO: 4350 - DNA, 19 bp, Homo sapiens
agcaccatttgaaatcggt

SEQ ID NO: 4351 - DNA, 21 bp, Homo sapiens
tcacacagaaatcgcacccgt

SEQ ID NO: 4352 - DNA, 24 bp, Homo sapiens
tactgcagacagtggcaatcatgt

SEQ ID NO: 4353 - DNA, 20 bp, Homo sapiens
gaggtagtaggttgcatagt

SEQ ID NO: 4354 - DNA, 16 bp, Homo sapiens
tacagtagtctgcaca

SEQ ID NO: 4355 - DNA, 20 bp, Homo sapiens
tcagttccaggccaaccagg

SEQ ID NO: 4356 - DNA, 19 bp, Homo sapiens
tgcattgtagttgcattgc

SEQ ID NO: 4357 - DNA, 22 bp, Homo sapiens
agttaggattaggtcgtggaag

SEQ ID NO: 4358 - DNA, 22 bp, Homo sapiens
agaggctggccgtgatgaattc

SEQ ID NO: 4359 - DNA, 20 bp, Homo sapiens
ctggcctacaaagtcccagt

SEQ ID NO: 4360 - DNA, 19 bp, Homo sapiens
atactgccgggtaatgatg

SEQ ID NO: 4361 - DNA, 20 bp, Homo sapiens
tctctcggctcctcgcggct

SEQ ID NO: 4362 - DNA, 20 bp, Homo sapiens
ataatacatggttaacctct

SEQ ID NO: 4363 - DNA, 19 bp, Homo sapiens
aatggcgccactagggttg

SEQ ID NO: 4364 - DNA, 22 bp, Homo sapiens
actggttgaacaactgaaccca

SEQ ID NO: 4365 - DNA, 21 bp, Homo sapiens
attacagttgttcaaccagtt

SEQ ID NO: 4366 - DNA, 18 bp, Homo sapiens
attgtagccttttggagt

SEQ ID NO: 4367 - DNA, 24 bp, Homo sapiens
tgctgaagctcagagggctctgat

SEQ ID NO: 4368 - DNA, 19 bp, Homo sapiens
agatcgaccgtgttatatt

SEQ ID NO: 4369 - DNA, 25 bp, Homo sapiens
ttcaagtaatccaggataggctgtt

SEQ ID NO: 4370 - DNA, 21 bp, Homo sapiens
tagtcagtagttggggggtgg

SEQ ID NO: 4371 - DNA, 19 bp, Homo sapiens
gctgggttgagagggcgaa

SEQ ID NO: 4372 - DNA, 17 bp, Homo sapiens
tgtgactggttgaccag

SEQ ID NO: 4373 - DNA, 19 bp, Homo sapiens
ttctcaagagggaggcaat

SEQ ID NO: 4374 - DNA, 19 bp, Homo sapiens
agcagcaattcatgttttg

SEQ ID NO: 4375 - DNA, 21 bp, Homo sapiens
ttcacagtggctaagttctgc

SEQ ID NO: 4376 - DNA, 22 bp, Homo sapiens
ttcactggagtttgtttcaata

SEQ ID NO: 4377 - DNA, 21 bp, Homo sapiens
gaattgttggtgttagccctg

SEQ ID NO: 4378 - DNA, 21 bp, Homo sapiens
agtgctgcgacatttgagcgt

SEQ ID NO: 4379 - DNA, 25 bp, Homo sapiens
aacattcattgctgtcggtgggttg

SEQ ID NO: 4380 - DNA, 20 bp, Homo sapiens
aggcagtgtcattagctgat

SEQ ID NO: 4381 - DNA, 23 bp, Homo sapiens
ctctagatggaagcactgtctgt

SEQ ID NO: 4382 - DNA, 23 bp, Homo sapiens
ctgggatctccggggtcttggtt

SEQ ID NO: 4383 - DNA, 19 bp, Homo sapiens
ctctacagggaagcgcttt

SEQ ID NO: 4384 - DNA, 23 bp, Homo sapiens
aggactccatttgttttgatgat

SEQ ID NO: 4385 - DNA, 29 bp, Homo sapiens
cagcactagattgtaaagactggggtgga

SEQ ID NO: 4386 - DNA, 21 bp, Homo sapiens
cctccctgggctctgcctccc

SEQ ID NO: 4387 - DNA, 20 bp, Homo sapiens
ataatacaacctgctaagtg

SEQ ID NO: 4388 - DNA, 21 bp, Homo sapiens
agtgcttacagtgcaggtagt

SEQ ID NO: 4389 - DNA, 20 bp, Homo sapiens
tttgataagctgacatggga

SEQ ID NO: 4390 - DNA, 24 bp, Homo sapiens
taaggtgcatctagtgcagatagt

SEQ ID NO: 4391 - DNA, 26 bp, Homo sapiens
agcactagattgtaaagactggggtg

SEQ ID NO: 4392 - DNA, 24 bp, Homo sapiens
atgcacctgggcaaggattctgag

SEQ ID NO: 4393 - DNA, 19 bp, Homo sapiens
cactgtctggtaacgatgt

SEQ ID NO: 4394 - DNA, 22 bp, Homo sapiens
tctttcgggccgtagagccagg

SEQ ID NO: 4395 - DNA, 25 bp, Homo sapiens
atgagtgtactgtgggcttcggaga

SEQ ID NO: 4396 - DNA, 24 bp, Homo sapiens
atgagtgtactgtgggcttcggag

SEQ ID NO: 4397 - DNA, 19 bp, Homo sapiens
tccgagcctgggtctccct

SEQ ID NO: 4398 - DNA, 23 bp, Homo sapiens
tgtaaacatccttgactggaagc

SEQ ID NO: 4399 - DNA, 18 bp, Homo sapiens
gcttatcagactgatgtt

SEQ ID NO: 4400 - DNA, 20 bp, Homo sapiens
gtagcttatcagactgatgt

SEQ ID NO: 4401 - DNA, 18 bp, Homo sapiens
gtactgtgataactgaag

SEQ ID NO: 4402 - DNA, 22 bp, Homo sapiens
ctcggggatcatcatgtcacga

SEQ ID NO: 4403 - DNA, 27 bp, Homo sapiens
ttatcagactgatgttgactgttgaat

SEQ ID NO: 4404 - DNA, 23 bp, Homo sapiens
tgtaaacatcctacactctcagc

SEQ ID NO: 4405 - DNA, 17 bp, Homo sapiens
gagcaataacgaaaaat

SEQ ID NO: 4406 - DNA, 29 bp, Homo sapiens
gcatgtgatgaagcaaatcagtatgaatg

SEQ ID NO: 4407 - DNA, 20 bp, Homo sapiens
acatagaggaaattccacgt

SEQ ID NO: 4408 - DNA, 17 bp, Homo sapiens
tatgtctgctgaccatc

SEQ ID NO: 4409 - DNA, 19 bp, Homo sapiens
ttcaacgctgtcggtgagt

SEQ ID NO: 4410 - DNA, 28 bp, Homo sapiens
caaagtgctgttcgtgcaggtagtgtga

SEQ ID NO: 4411 - DNA, 22 bp, Homo sapiens
tacggtgagcctgtcattattc

SEQ ID NO: 4412 - DNA, 20 bp, Homo sapiens
tgcagtccatgggcatatac

SEQ ID NO: 4413 - DNA, 21 bp, Homo sapiens
acaggcggctgtagcaatggg

SEQ ID NO: 4414 - DNA, 20 bp, Homo sapiens
tgtatgccctcaccgctcag

SEQ ID NO: 4415 - DNA, 21 bp, Homo sapiens
cgaggagctcacagtctagta

SEQ ID NO: 4416 - DNA, 17 bp, Homo sapiens
ctagcaccatctgaaat

SEQ ID NO: 4417 - DNA, 18 bp, Homo sapiens
gtgaaatgtttaggacca

SEQ ID NO: 4418 - DNA, 21 bp, Homo sapiens
agtgcttcgattttggggtgt

SEQ ID NO: 4419 - DNA, 21 bp, Homo sapiens
tcacacctgcctcgcccccca

SEQ ID NO: 4420 - DNA, 18 bp, Homo sapiens
tgcattgtagttgcattg

SEQ ID NO: 4421 - DNA, 20 bp, Homo sapiens
ccataaagtagaaagcacta

SEQ ID NO: 4422 - DNA, 19 bp, Homo sapiens
gtgtttcctactttatgga

SEQ ID NO: 4423 - DNA, 21 bp, Homo sapiens
aggcagtgtattgttagctgg

SEQ ID NO: 4424 - DNA, 23 bp, Homo sapiens
tgaggtagtagtttgtgctgttg

SEQ ID NO: 4425 - DNA, 19 bp, Homo sapiens
atcttaccggacagtgctg

SEQ ID NO: 4426 - DNA, 19 bp, Homo sapiens
ggcaatggtagaactcaca

SEQ ID NO: 4427 - DNA, 21 bp, Homo sapiens
cagcactagattgtaaagact

SEQ ID NO: 4428 - DNA, 21 bp, Homo sapiens
ataggactcatatagtgccag

SEQ ID NO: 4429 - DNA, 19 bp, Homo sapiens
acatccttgactggaagct

SEQ ID NO: 4430 - DNA, 19 bp, Homo sapiens
tcttaccggacagtgctgg

SEQ ID NO: 4431 - DNA, 22 bp, Homo sapiens
tcttaccggacagtgctggatt

SEQ ID NO: 4432 - DNA, 22 bp, Homo sapiens
ctaacactgtctggtaacgatg

SEQ ID NO: 4433 - DNA, 19 bp, Homo sapiens
aatatctcaggctgtgacc

SEQ ID NO: 4434 - DNA, 17 bp, Homo sapiens
ctgggagaaggctgttt

SEQ ID NO: 4435 - DNA, 22 bp, Homo sapiens
tgtgcgtgtgacagcggctgat

SEQ ID NO: 4436 - DNA, 19 bp, Homo sapiens
tggaatgtaaggaagtgtg

SEQ ID NO: 4437 - DNA, 18 bp, Homo sapiens
cagcaactccatgtggac

SEQ ID NO: 4438 - DNA, 23 bp, Homo sapiens
cagcactagattgtaaagactgg

SEQ ID NO: 4439 - DNA, 24 bp, Homo sapiens
taaagtgctgacagtgcagatagt

SEQ ID NO: 4440 - DNA, 22 bp, Homo sapiens
aggaccttccctgaaccaagga

SEQ ID NO: 4441 - DNA, 16 bp, Homo sapiens
actcaaactgtggggg

SEQ ID NO: 4442 - DNA, 22 bp, Homo sapiens
cttgcaacgaacctgagccact

SEQ ID NO: 4443 - DNA, 20 bp, Homo sapiens
taggcagtgtagttagctga

SEQ ID NO: 4444 - DNA, 23 bp, Homo sapiens
atgtagggatggaagccatgaaa

SEQ ID NO: 4445 - DNA, 20 bp, Homo sapiens
cggacaggcgttcgtgcgac

SEQ ID NO: 4446 - DNA, 17 bp, Homo sapiens
ataccctgtagatccga

SEQ ID NO: 4447 - DNA, 22 bp, Homo sapiens
tgaggtagtaggttgtatggtt

SEQ ID NO: 4448 - DNA, 20 bp, Homo sapiens
ggtagactatggaacgtagg

SEQ ID NO: 4449 - DNA, 18 bp, Homo sapiens
cagtgcactacagaactt

SEQ ID NO: 4450 - DNA, 22 bp, Homo sapiens
gctcctatatgatgcctttctt

SEQ ID NO: 4451 - DNA, 25 bp, Homo sapiens
atccccagatacaatggacaatatg

SEQ ID NO: 4452 - DNA, 19 bp, Homo sapiens
cattcaacgctgtcggtga

SEQ ID NO: 4453 - DNA, 22 bp, Homo sapiens
caacaggcggctgtagcaatgg

SEQ ID NO: 4454 - DNA, 22 bp, Homo sapiens
actatagaactttccccctcat

SEQ ID NO: 4455 - DNA, 19 bp, Homo sapiens
taatacatggttgatcttt

SEQ ID NO: 4456 - DNA, 22 bp, Homo sapiens
caacaacattaaaccacccgat

SEQ ID NO: 4457 - DNA, 19 bp, Homo sapiens
tagcagcacataatggttt

SEQ ID NO: 4458 - DNA, 24 bp, Homo sapiens
ccctgtagatccgaatttgtgtaa

SEQ ID NO: 4459 - DNA, 21 bp, Homo sapiens
gcagggacagcaaaggggtgc

SEQ ID NO: 4460 - DNA, 18 bp, Homo sapiens
aacgaacctgagccactg

SEQ ID NO: 4461 - DNA, 17 bp, Homo sapiens
acgaacctgagccactg

SEQ ID NO: 4462 - DNA, 20 bp, Homo sapiens
ggtagtttcctgttgttggg

SEQ ID NO: 4463 - DNA, 22 bp, Homo sapiens
taaatcccatggtgccttctcc

SEQ ID NO: 4464 - DNA, 23 bp, Homo sapiens
cccataaagtagaaagcactact

SEQ ID NO: 4465 - DNA, 19 bp, Homo sapiens
tcggctctgggtctgtggg

SEQ ID NO: 4466 - DNA, 25 bp, Homo sapiens
caacggaatcccaaaagcagctgtt

SEQ ID NO: 4467 - DNA, 18 bp, Homo sapiens
cgaacctgagccactgat

SEQ ID NO: 4468 - DNA, 19 bp, Homo sapiens
gcaacgaacctgagccact

SEQ ID NO: 4469 - DNA, 15 bp, Homo sapiens
cgaacctgagccact

SEQ ID NO: 4470 - DNA, 19 bp, Homo sapiens
aagtgctgttcgtgcaggt

SEQ ID NO: 4471 - DNA, 19 bp, Homo sapiens
aaagtgcttcctttttgag

SEQ ID NO: 4472 - DNA, 21 bp, Homo sapiens
tcacagtggctaagttctgca

SEQ ID NO: 4473 - DNA, 18 bp, Homo sapiens
gctgtaccaccttgtcgg

SEQ ID NO: 4474 - DNA, 19 bp, Homo sapiens
tcgtgtcttgtgttgcagc

SEQ ID NO: 4475 - DNA, 20 bp, Homo sapiens
tgccctggcccgagggaccg

SEQ ID NO: 4476 - DNA, 23 bp, Homo sapiens
tttgggactgatcttgatgtctg

SEQ ID NO: 4477 - DNA, 23 bp, Homo sapiens
gaaggcgcttccctttagagcgt

SEQ ID NO: 4478 - DNA, 17 bp, Homo sapiens
tgtaaacatcctcgact

SEQ ID NO: 4479 - DNA, 21 bp, Homo sapiens
tatgtgggatggtaaaccgct

SEQ ID NO: 4480 - DNA, 19 bp, Homo sapiens
acagggtagaaccacggac

SEQ ID NO: 4481 - DNA, 18 bp, Homo sapiens
tgccagttgaagaactgt

SEQ ID NO: 4482 - DNA, 17 bp, Homo sapiens
aacgaacctgagccact

SEQ ID NO: 4483 - DNA, 20 bp, Homo sapiens
actgtgtcctttctgcgtag

SEQ ID NO: 4484 - DNA, 20 bp, Homo sapiens
tgactgacacctctttgggt

SEQ ID NO: 4485 - DNA, 16 bp, Homo sapiens
tgcaacgaacctgagc

SEQ ID NO: 4486 - DNA, 21 bp, Homo sapiens
aactattccctttctgagtag

SEQ ID NO: 4487 - DNA, 17 bp, Homo sapiens
gaacctgagccactgat

SEQ ID NO: 4488 - DNA, 19 bp, Homo sapiens
acgaacctgagccactgat

SEQ ID NO: 4489 - DNA, 22 bp, Homo sapiens
aactattccctttctgagtaga

SEQ ID NO: 4490 - DNA, 18 bp, Homo sapiens
gtgcattgtagttgcatt

SEQ ID NO: 4491 - DNA, 23 bp, Homo sapiens
ttcacagggaggtgtcatttatg

SEQ ID NO: 4492 - DNA, 23 bp, Homo sapiens
ggctgccaattccataggtcaca

SEQ ID NO: 4493 - DNA, 22 bp, Homo sapiens
cccaatacacggtcgacctctt

SEQ ID NO: 4494 - DNA, 22 bp, Homo sapiens
caagaggatctcaggctgtgac

SEQ ID NO: 4495 - DNA, 17 bp, Homo sapiens
ccgttaccattactgag

SEQ ID NO: 4496 - DNA, 24 bp, Homo sapiens
gctacatctggctactgggtctct

SEQ ID NO: 4497 - DNA, 30 bp, Homo sapiens
agcactagattgtaaagactggggtggacc

SEQ ID NO: 4498 - DNA, 21 bp, Homo sapiens
gaacatcacagcaagtctgtg

SEQ ID NO: 4499 - DNA, 17 bp, Homo sapiens
gttaccattactgagtt

SEQ ID NO: 4500 - DNA, 20 bp, Homo sapiens
gcactggtagaattcactgt

SEQ ID NO: 4501 - DNA, 18 bp, Homo sapiens
aagacgggaggaaagaag

SEQ ID NO: 4502 - DNA, 20 bp, Homo sapiens
ggtagtaggttgtatagttt

SEQ ID NO: 4503 - DNA, 21 bp, Homo sapiens
ctgtcctaaggttgttgagtt

SEQ ID NO: 4504 - DNA, 23 bp, Homo sapiens
ttaatatcggacaaccattgttt

SEQ ID NO: 4505 - DNA, 24 bp, Homo sapiens
ttgaggtagtaggttgtatggttt

SEQ ID NO: 4506 - DNA, 20 bp, Homo sapiens
ctgtcctaaggttgttgagt

SEQ ID NO: 4507 - DNA, 23 bp, Homo sapiens
cctctagaggaagcactttctgt

SEQ ID NO: 4508 - DNA, 19 bp, Homo sapiens
aaagttctgagacactccg

SEQ ID NO: 4509 - DNA, 18 bp, Homo sapiens
caggtcgtcttgcagggc

SEQ ID NO: 4510 - DNA, 23 bp, Homo sapiens
ctgtttgcagaggaaactgagac

SEQ ID NO: 4511 - DNA, 20 bp, Homo sapiens
cgtgcatccctttagagtgt

SEQ ID NO: 4512 - DNA, 18 bp, Homo sapiens
gttaccattactgagttt

SEQ ID NO: 4513 - DNA, 17 bp, Homo sapiens
tcatcatatactgtaag

SEQ ID NO: 4514 - DNA, 19 bp, Homo sapiens
ggtagtttcctgttgttgg

SEQ ID NO: 4515 - DNA, 22 bp, Homo sapiens
ctcactgatcaatgaatgcaaa

SEQ ID NO: 4516 - DNA, 22 bp, Homo sapiens
ctgtgggccacctagtcaccaa

SEQ ID NO: 4517 - DNA, 18 bp, Homo sapiens
ttggcaatggtagaactc

SEQ ID NO: 4518 - DNA, 29 bp, Homo sapiens
tatggcactggtagaattcactgtgaaca

SEQ ID NO: 4519 - DNA, 15 bp, Homo sapiens
aaacccgtagatccg

SEQ ID NO: 4520 - DNA, 19 bp, Homo sapiens
gcaatggtagaactcacac

SEQ ID NO: 4521 - DNA, 23 bp, Homo sapiens
agggacttttgggggcagatgtg

SEQ ID NO: 4522 - DNA, 19 bp, Homo sapiens
tctcactgtagcctcgaac

SEQ ID NO: 4523 - DNA, 21 bp, Homo sapiens
cacctgccgcgccccccgggc

SEQ ID NO: 4524 - DNA, 21 bp, Homo sapiens
aagaagatctcagcctgtgac

SEQ ID NO: 4525 - DNA, 19 bp, Homo sapiens
cggatccgtctgagcttgg

SEQ ID NO: 4526 - DNA, 22 bp, Homo sapiens
agaggtagtaggttgcatagtt

SEQ ID NO: 4527 - DNA, 17 bp, Homo sapiens
aaccgttaccattactg

SEQ ID NO: 4528 - DNA, 22 bp, Homo sapiens
attaatatcggacaaccattgt

SEQ ID NO: 4529 - DNA, 25 bp, Homo sapiens
cttcctgagcacgctcatgatgagc

SEQ ID NO: 4530 - DNA, 18 bp, Homo sapiens
ccacagggtagaaccacg

SEQ ID NO: 4531 - DNA, 21 bp, Homo sapiens
agaccctggtctgcactctat

SEQ ID NO: 4532 - DNA, 16 bp, Homo sapiens
acatcctacactcagc

SEQ ID NO: 4533 - DNA, 21 bp, Homo sapiens
aaccgtggctttcgattgtta

SEQ ID NO: 4534 - DNA, 19 bp, Homo sapiens
ttgtgacagattgataact

SEQ ID NO: 4535 - DNA, 28 bp, Homo sapiens
acagcactagattgtaaagactggggtg

SEQ ID NO: 4536 - DNA, 23 bp, Homo sapiens
agaagcattctttcattggttgg

SEQ ID NO: 4537 - DNA, 22 bp, Homo sapiens
acaaagtgcctccctttagagt

SEQ ID NO: 4538 - DNA, 20 bp, Homo sapiens
gaaagcgcttctctttagag

SEQ ID NO: 4539 - DNA, 24 bp, Homo sapiens
acattcaacgctgtcggtgagttt

SEQ ID NO: 4540 - DNA, 20 bp, Homo sapiens
cagtactgtgataactgaag

SEQ ID NO: 4541 - DNA, 19 bp, Homo sapiens
aagtgctgacagtgcagat

SEQ ID NO: 4542 - DNA, 22 bp, Homo sapiens
ttcaagtaattcaggataggtt

SEQ ID NO: 4543 - DNA, 22 bp, Homo sapiens
ctggagatatggaagagctgtg

SEQ ID NO: 4544 - DNA, 21 bp, Homo sapiens
agtcatacacggctctcctct

SEQ ID NO: 4545 - DNA, 21 bp, Homo sapiens
aagtgcttcctttttgagggt

SEQ ID NO: 4546 - DNA, 21 bp, Homo sapiens
aggggtgctatctgtgattga

SEQ ID NO: 4547 - DNA, 19 bp, Homo sapiens
tatcatcatatactgtaag

SEQ ID NO: 4548 - DNA, 18 bp, Homo sapiens
cctatgaattgacagcca

SEQ ID NO: 4549 - DNA, 23 bp, Homo sapiens
tgccctggcccgagggaccgact

SEQ ID NO: 4550 - DNA, 21 bp, Homo sapiens
agtgctgtcatagctgaggtc

SEQ ID NO: 4551 - DNA, 19 bp, Homo sapiens
ctttcagtcagatgtttgc

SEQ ID NO: 4552 - DNA, 22 bp, Homo sapiens
accactgaccgttgactgtacc

SEQ ID NO: 4553 - DNA, 20 bp, Homo sapiens
ggagaaattatccttggtgt

SEQ ID NO: 4554 - DNA, 27 bp, Homo sapiens
agctacatctggctactgggtctctga

SEQ ID NO: 4555 - DNA, 22 bp, Homo sapiens
actggctcagttcagcaggaac

SEQ ID NO: 4556 - DNA, 20 bp, Homo sapiens
tgaggagatcgtcgaggttg

SEQ ID NO: 4557 - DNA, 24 bp, Homo sapiens
accgttaccattactgagtttagt

SEQ ID NO: 4558 - DNA, 19 bp, Homo sapiens
gtgcttccttttagagggt

SEQ ID NO: 4559 - DNA, 20 bp, Homo sapiens
gtgctgtcatagctgaggtc

SEQ ID NO: 4560 - DNA, 20 bp, Homo sapiens
aagcgcttcccttcagagtg

SEQ ID NO: 4561 - DNA, 21 bp, Homo sapiens
aagtgcatccttttagaggtt

SEQ ID NO: 4562 - DNA, 21 bp, Homo sapiens
tcggcgtggcgtcggtcgtgg

SEQ ID NO: 4563 - DNA, 21 bp, Homo sapiens
tgaaacatacacgggaaacct

SEQ ID NO: 4564 - DNA, 21 bp, Homo sapiens
acctctgaaattcagttcttc

SEQ ID NO: 4565 - DNA, 24 bp, Homo sapiens
tggaaacatttctgcacaaactag

SEQ ID NO: 4566 - DNA, 18 bp, Homo sapiens
aaccgttaccattactga

SEQ ID NO: 4567 - DNA, 21 bp, Homo sapiens
agtgtttcctactttatggat

SEQ ID NO: 4568 - DNA, 24 bp, Homo sapiens
taatctcagctggcaactgtgaga

SEQ ID NO: 4569 - DNA, 29 bp, Homo sapiens
ctgtggtagtgaaaagtctgtagaaaagt

SEQ ID NO: 4570 - DNA, 21 bp, Homo sapiens
agctggtaaaatggaaccaaa

SEQ ID NO: 4571 - DNA, 21 bp, Homo sapiens
gggagccaggaagtattgatg

SEQ ID NO: 4572 - DNA, 23 bp, Homo sapiens
acctggacccagcgtagacaaag

SEQ ID NO: 4573 - DNA, 22 bp, Homo sapiens
cttatgcaagattcccttctac

SEQ ID NO: 4574 - DNA, 21 bp, Homo sapiens
aggtggtccgtggcgcgttcg

SEQ ID NO: 4575 - DNA, 19 bp, Homo sapiens
gaagctcagagggctctga

SEQ ID NO: 4576 - DNA, 21 bp, Homo sapiens
cttttctgtggtacttgaaga

SEQ ID NO: 4577 - DNA, 19 bp, Homo sapiens
taaagtagaaagcactact

SEQ ID NO: 4578 - DNA, 21 bp, Homo sapiens
taatacatggttaacctcttt

SEQ ID NO: 4579 - DNA, 18 bp, Homo sapiens
tacagtagtctgcacatt

SEQ ID NO: 4580 - DNA, 20 bp, Homo sapiens
gaggtagtagtttgtacagt

SEQ ID NO: 4581 - DNA, 22 bp, Homo sapiens
gttgtgtcagtttatcaaaccc

SEQ ID NO: 4582 - DNA, 24 bp, Homo sapiens
actgccctaagtgctccttctggc

SEQ ID NO: 4583 - DNA, 24 bp, Homo sapiens
cctctagatggaagcactgtctgt

SEQ ID NO: 4584 - DNA, 20 bp, Homo sapiens
acagtactgtgataactgaa

SEQ ID NO: 4585 - DNA, 18 bp, Homo sapiens
tgggtttacgttgggaga

SEQ ID NO: 4586 - DNA, 21 bp, Homo sapiens
gttgtgtcagtttatcaaacc

SEQ ID NO: 4587 - DNA, 21 bp, Homo sapiens
ttgtgtcagtttatcaaaccc

SEQ ID NO: 4588 - DNA, 19 bp, Homo sapiens
ttcacaaggaggtgtcatt

SEQ ID NO: 4589 - DNA, 19 bp, Homo sapiens
cagtgcaatgatgaaaggg

SEQ ID NO: 4590 - DNA, 24 bp, Homo sapiens
tttggtccccttcaaccagctgta

SEQ ID NO: 4591 - DNA, 18 bp, Homo sapiens
ttcctatgcatatacttc

SEQ ID NO: 4592 - DNA, 20 bp, Homo sapiens
ctccatttgttttgatgatg

SEQ ID NO: 4593 - DNA, 19 bp, Homo sapiens
ttattacttttggtacgcg

SEQ ID NO: 4594 - DNA, 20 bp, Homo sapiens
gtagaggagatggcgcaggg

SEQ ID NO: 4595 - DNA, 24 bp, Homo sapiens
taccgcactgtgggtacttgctgc

SEQ ID NO: 4596 - DNA, 22 bp, Homo sapiens
tatacctcagttttatcaggtg

SEQ ID NO: 4597 - DNA, 18 bp, Homo sapiens
aatgttgctcggtgaacc

SEQ ID NO: 4598 - DNA, 19 bp, Homo sapiens
tagactgaagctccttgag

SEQ ID NO: 4599 - DNA, 21 bp, Homo sapiens
gcggggctagggctaacagca

SEQ ID NO: 4600 - DNA, 15 bp, Homo sapiens
tttcagtcggatgtt

SEQ ID NO: 4601 - DNA, 21 bp, Homo sapiens
atggcttttcattcctatgtg

SEQ ID NO: 4602 - DNA, 16 bp, Homo sapiens
tgtttaggaccactag

SEQ ID NO: 4603 - DNA, 23 bp, Homo sapiens
gtccagttttcccaggaatccct

SEQ ID NO: 4604 - DNA, 21 bp, Homo sapiens
atacacatacacgcaacacac

SEQ ID NO: 4605 - DNA, 25 bp, Homo sapiens
ctagagagcactgagcgacagatac

SEQ ID NO: 4606 - DNA, 18 bp, Homo sapiens
tccctgagaccctttaac

SEQ ID NO: 4607 - DNA, 19 bp, Homo sapiens
catatgtctgctgaccatc

SEQ ID NO: 4608 - DNA, 22 bp, Homo sapiens
catctgatatacaatattttct

SEQ ID NO: 4609 - DNA, 21 bp, Homo sapiens
aatctcagctggcaactgtga

SEQ ID NO: 4610 - DNA, 20 bp, Homo sapiens
tcctgactccaggtcctgtg

SEQ ID NO: 4611 - DNA, 23 bp, Homo sapiens
tagtagattgtatagttgtgggg

SEQ ID NO: 4612 - DNA, 23 bp, Homo sapiens
agcgctttgctcagccagtgtag

SEQ ID NO: 4613 - DNA, 19 bp, Homo sapiens
tacattgtctgctgggttt

SEQ ID NO: 4614 - DNA, 22 bp, Homo sapiens
atcagttcctaatgcattgcct

SEQ ID NO: 4615 - DNA, 19 bp, Homo sapiens
aataatacatggttgatct

SEQ ID NO: 4616 - DNA, 24 bp, Homo sapiens
tcgtgtcttgtgttgcagccggag

SEQ ID NO: 4617 - DNA, 22 bp, Homo sapiens
tggaaacatttctgcacaaact

SEQ ID NO: 4618 - DNA, 19 bp, Homo sapiens
aacgccattatcacactaa

SEQ ID NO: 4619 - DNA, 20 bp, Homo sapiens
tgactggttgaccagagggg

SEQ ID NO: 4620 - DNA, 23 bp, Homo sapiens
atgcacctgggcaaggattctga

SEQ ID NO: 4621 - DNA, 20 bp, Homo sapiens
ctttcagtcagatgtttgct

SEQ ID NO: 4622 - DNA, 22 bp, Homo sapiens
gtagaggagatggcgcagggga

SEQ ID NO: 4623 - DNA, 17 bp, Homo sapiens
tcagtgcactacagaac

SEQ ID NO: 4624 - DNA, 21 bp, Homo sapiens
aaacatcctcgactggaagct

SEQ ID NO: 4625 - DNA, 20 bp, Homo sapiens
ttgtgtcagtttatcaaacc

SEQ ID NO: 4626 - DNA, 22 bp, Homo sapiens
ttgtgtcagtttatcaaaccca

SEQ ID NO: 4627 - DNA, 28 bp, Homo sapiens
ttatcagactgatgttgactgttgaatc

SEQ ID NO: 4628 - DNA, 22 bp, Homo sapiens
agtgcctgagggagtaagagcc

SEQ ID NO: 4629 - DNA, 17 bp, Homo sapiens
tgggtttacgttgggag

SEQ ID NO: 4630 - DNA, 24 bp, Homo sapiens
agatcgaccgtgttatattcgctt

SEQ ID NO: 4631 - DNA, 20 bp, Homo sapiens
cagcacgtaaatattggcgt

SEQ ID NO: 4632 - DNA, 22 bp, Homo sapiens
agaggataccctttgtatgttc

SEQ ID NO: 4633 - DNA, 27 bp, Homo sapiens
tcatgatactgtaaacgctttctgatg

SEQ ID NO: 4634 - DNA, 22 bp, Homo sapiens
taaacatccccgactggaagct

SEQ ID NO: 4635 - DNA, 19 bp, Homo sapiens
aatcactaaccacacggcc

SEQ ID NO: 4636 - DNA, 21 bp, Homo sapiens
gagggagggacgggggctgtg

SEQ ID NO: 4637 - DNA, 18 bp, Homo sapiens
acatccttgactggaagc

SEQ ID NO: 4638 - DNA, 23 bp, Homo sapiens
aaactgtaattacttttggacca

SEQ ID NO: 4639 - DNA, 20 bp, Homo sapiens
caaagcgcttctctttagag

SEQ ID NO: 4640 - DNA, 19 bp, Homo sapiens
ttttgcaatatgttcctga

SEQ ID NO: 4641 - DNA, 19 bp, Homo sapiens
gtgtgcggaaatgcttctg

SEQ ID NO: 4642 - DNA, 23 bp, Homo sapiens
ttcgggctggcctgctgctccgg

SEQ ID NO: 4643 - DNA, 20 bp, Homo sapiens
tgaaggtctactgtgtgcca

SEQ ID NO: 4644 - DNA, 23 bp, Homo sapiens
tcagttatcacagtgctgatgct

SEQ ID NO: 4645 - DNA, 18 bp, Homo sapiens
cagcacatcatggtttac

SEQ ID NO: 4646 - DNA, 22 bp, Homo sapiens
cctgctggggtggaacctggtc

SEQ ID NO: 4647 - DNA, 21 bp, Homo sapiens
gaaggcgcttccctttagagc

SEQ ID NO: 4648 - DNA, 19 bp, Homo sapiens
gcaatgttaaaagggcatt

SEQ ID NO: 4649 - DNA, 22 bp, Homo sapiens
cgaaaacagcaattacctttgc

SEQ ID NO: 4650 - DNA, 20 bp, Homo sapiens
cagctacattgtctgctggg

SEQ ID NO: 4651 - DNA, 21 bp, Homo sapiens
acgctcatgcacacacccaca

SEQ ID NO: 4652 - DNA, 23 bp, Homo sapiens
ctaacactgtctggtaacgatgt

SEQ ID NO: 4653 - DNA, 19 bp, Homo sapiens
caaagcgctcccctttaga

SEQ ID NO: 4654 - DNA, 18 bp, Homo sapiens
atcgtgcatccctttaga

SEQ ID NO: 4655 - DNA, 20 bp, Homo sapiens
atcgtacagggtcatccact

SEQ ID NO: 4656 - DNA, 17 bp, Homo sapiens
ctgtatgccctcaccgc

SEQ ID NO: 4657 - DNA, 17 bp, Homo sapiens
gcaccatttgaaatcgg

SEQ ID NO: 4658 - DNA, 22 bp, Homo sapiens
aggcagtgtattgttagctggc

SEQ ID NO: 4659 - DNA, 19 bp, Homo sapiens
gaaggtctcgggctgtgac

SEQ ID NO: 4660 - DNA, 18 bp, Homo sapiens
ttggtccccttcaaccag

SEQ ID NO: 4661 - DNA, 19 bp, Homo sapiens
cccagtgtttagactatct

SEQ ID NO: 4662 - DNA, 16 bp, Homo sapiens
tacagtatagatgatg

SEQ ID NO: 4663 - DNA, 19 bp, Homo sapiens
gtcactagtggttccgttt

SEQ ID NO: 4664 - DNA, 20 bp, Homo sapiens
ttattgcttaagaatacgcg

SEQ ID NO: 4665 - DNA, 22 bp, Homo sapiens
cgtgtcttgtgttgcagccgga

SEQ ID NO: 4666 - DNA, 23 bp, Homo sapiens
agctggtaaaatggaaccaaatc

SEQ ID NO: 4667 - DNA, 22 bp, Homo sapiens
cggggcagctcagtacaggata

SEQ ID NO: 4668 - DNA, 24 bp, Homo sapiens
gaagtgcttcgattttggggtgtc

SEQ ID NO: 4669 - DNA, 22 bp, Homo sapiens
tggtccccttcaaccagctgta

SEQ ID NO: 4670 - DNA, 18 bp, Homo sapiens
tggaatgtaaagaagtat

SEQ ID NO: 4671 - DNA, 22 bp, Homo sapiens
cctgactccaggtcctgtgtgt

SEQ ID NO: 4672 - DNA, 18 bp, Homo sapiens
tggaatgtaaggaagtgt

SEQ ID NO: 4673 - DNA, 23 bp, Homo sapiens
acatacttctttatatgcccata

SEQ ID NO: 4674 - DNA, 23 bp, Homo sapiens
tggaatgtaaagaagtatgtatc

SEQ ID NO: 4675 - DNA, 21 bp, Homo sapiens
aacaaatcacagtctgccata

SEQ ID NO: 4676 - DNA, 18 bp, Homo sapiens
tgctgacatatttactag

SEQ ID NO: 4677 - DNA, 18 bp, Homo sapiens
ttatcagaatctccaggg

SEQ ID NO: 4678 - DNA, 17 bp, Homo sapiens
gcaccatctgaaatcgg

SEQ ID NO: 4679 - DNA, 30 bp, Homo sapiens
ccctcctgatgattcttcttcctgagcacg

SEQ ID NO: 4680 - DNA, 23 bp, Homo sapiens
ttgtgaaatgtttaggaccacta

SEQ ID NO: 4681 - DNA, 24 bp, Homo sapiens
ctaacactgtctggtaaagatggc

SEQ ID NO: 4682 - DNA, 17 bp, Homo sapiens
tagtctgcacattggtt

SEQ ID NO: 4683 - DNA, 20 bp, Homo sapiens
tatgtgggatggtaaaccgc

SEQ ID NO: 4684 - DNA, 21 bp, Homo sapiens
tccagtaccacgtgtcagggc

SEQ ID NO: 4685 - DNA, 22 bp, Homo sapiens
ggtcgtatgtgtgacgccattt

SEQ ID NO: 4686 - DNA, 25 bp, Homo sapiens
tcaacaaaatcactgatgctggagt

SEQ ID NO: 4687 - DNA, 20 bp, Homo sapiens
ttgtgtcaatatgcgatgat

SEQ ID NO: 4688 - DNA, 18 bp, Homo sapiens
gcaccatttgaaatcggt

SEQ ID NO: 4689 - DNA, 19 bp, Homo sapiens
ctgattcctgggctctgac

SEQ ID NO: 4690 - DNA, 22 bp, Homo sapiens
gaggtagtaggttgtatagttt

SEQ ID NO: 4691 - DNA, 18 bp, Homo sapiens
ccctgtagatccgaattt

SEQ ID NO: 4692 - DNA, 23 bp, Homo sapiens
taaggcacgcggtgaatgccaag

SEQ ID NO: 4693 - DNA, 22 bp, Homo sapiens
cagttgctacagttccctgttg

SEQ ID NO: 4694 - DNA, 21 bp, Homo sapiens
ctgggatctccggggtcttgg

SEQ ID NO: 4695 - DNA, 18 bp, Homo sapiens
actctagagggaagcgct

SEQ ID NO: 4696 - DNA, 23 bp, Homo sapiens
ttctcaaggaggtgtcgtttatg

SEQ ID NO: 4697 - DNA, 23 bp, Homo sapiens
cgtggcgtccccttccccgccgg

SEQ ID NO: 4698 - DNA, 17 bp, Homo sapiens
catttgaaatcagtgtt

SEQ ID NO: 4699 - DNA, 23 bp, Homo sapiens
tttgtgacctggtccactaaccc

SEQ ID NO: 4700 - DNA, 22 bp, Homo sapiens
aggagcttacaatctagctggg

SEQ ID NO: 4701 - DNA, 18 bp, Homo sapiens
tgagaactgaattccata

SEQ ID NO: 4702 - DNA, 22 bp, Homo sapiens
agcaagatctcaggctgtgacc

SEQ ID NO: 4703 - DNA, 17 bp, Homo sapiens
agagttgtcatgtgtct

SEQ ID NO: 4704 - DNA, 20 bp, Homo sapiens
aaatgtttaggaccactaga

SEQ ID NO: 4705 - DNA, 20 bp, Homo sapiens
tgagtattacatggccaatc

SEQ ID NO: 4706 - DNA, 24 bp, Homo sapiens
tgacctatgaattgacagccagtg

SEQ ID NO: 4707 - DNA, 21 bp, Homo sapiens
caccttgcgctactcaggtct

SEQ ID NO: 4708 - DNA, 21 bp, Homo sapiens
ggtagtttcctgttgttggga

SEQ ID NO: 4709 - DNA, 24 bp, Homo sapiens
caccttgcgctactcaggtctgct

SEQ ID NO: 4710 - DNA, 19 bp, Homo sapiens
ctcccaacccttgtaccag

SEQ ID NO: 4711 - DNA, 20 bp, Homo sapiens
cgtgttcacagcggaccttg

SEQ ID NO: 4712 - DNA, 18 bp, Homo sapiens
tcgtaccgtgagtaataa

SEQ ID NO: 4713 - DNA, 21 bp, Homo sapiens
tagtaccagtaccttgtgttc

SEQ ID NO: 4714 - DNA, 18 bp, Homo sapiens
taaagctagataaccgaa

SEQ ID NO: 4715 - DNA, 19 bp, Homo sapiens
taaagctagataaccgaaa

SEQ ID NO: 4716 - DNA, 18 bp, Homo sapiens
gtagtagtttgtgctgtt

SEQ ID NO: 4717 - DNA, 20 bp, Homo sapiens
agactagtgattttgttgtt

SEQ ID NO: 4718 - DNA, 20 bp, Homo sapiens
gaatgttgctcggtgaaccc

SEQ ID NO: 4719 - DNA, 18 bp, Homo sapiens
tcacagtggctaagttct

SEQ ID NO: 4720 - DNA, 20 bp, Homo sapiens
tccatttgttttgatgatgg

SEQ ID NO: 4721 - DNA, 23 bp, Homo sapiens
acaccatgttgccagtctctagg

SEQ ID NO: 4722 - DNA, 21 bp, Homo sapiens
ccagtgtttagactatctgtt

SEQ ID NO: 4723 - DNA, 20 bp, Homo sapiens
aagaattctccttttgggct

SEQ ID NO: 4724 - DNA, 23 bp, Homo sapiens
ctctagccacagatgcagtgatt

SEQ ID NO: 4725 - DNA, 20 bp, Homo sapiens
gagaccgagtgcacagggct

SEQ ID NO: 4726 - DNA, 19 bp, Homo sapiens
aaggcagggcccccgctcc

SEQ ID NO: 4727 - DNA, 20 bp, Homo sapiens
gtatgtgcctttggactaca

SEQ ID NO: 4728 - DNA, 22 bp, Homo sapiens
aggggtctctgcctctacccag

SEQ ID NO: 4729 - DNA, 19 bp, Homo sapiens
gtagtaggttgtatagttt

SEQ ID NO: 4730 - DNA, 20 bp, Homo sapiens
tgccttgagtgtaggaccgt

SEQ ID NO: 4731 - DNA, 21 bp, Homo sapiens
gcaggaacttgtgagtctcct

SEQ ID NO: 4732 - DNA, 21 bp, Homo sapiens
gagaactgaattccataggct

SEQ ID NO: 4733 - DNA, 21 bp, Homo sapiens
gaggtagtagtttgtgctgtt

SEQ ID NO: 4734 - DNA, 21 bp, Homo sapiens
gcagtgtagttagctgattgc

SEQ ID NO: 4735 - DNA, 19 bp, Homo sapiens
tacgacctgctgcctttct

SEQ ID NO: 4736 - DNA, 17 bp, Homo sapiens
atgttgccagtctctag

SEQ ID NO: 4737 - DNA, 24 bp, Homo sapiens
taatgctaatcgtgataggggttt

SEQ ID NO: 4738 - DNA, 20 bp, Homo sapiens
tgtccttgctgtttggagat

SEQ ID NO: 4739 - DNA, 20 bp, Homo sapiens
gcacattacacggtcgacct

SEQ ID NO: 4740 - DNA, 20 bp, Homo sapiens
gcgacccatacttggtttca

SEQ ID NO: 4741 - DNA, 19 bp, Homo sapiens
catagaggctgtggctgga

SEQ ID NO: 4742 - DNA, 25 bp, Homo sapiens
ctctggatacctgtgtgtgatgagc

SEQ ID NO: 4743 - DNA, 21 bp, Homo sapiens
ttctaatttctccacgtcttt

SEQ ID NO: 4744 - DNA, 26 bp, Homo sapiens
ctgagcctctaagaagttgactgaag

SEQ ID NO: 4745 - DNA, 23 bp, Homo sapiens
cccctcagtccaccagagcccgg

SEQ ID NO: 4746 - DNA, 26 bp, Homo sapiens
tgtaaacatccccgactggaagctgt

SEQ ID NO: 4747 - DNA, 20 bp, Homo sapiens
gcagcattgtacagggctat

SEQ ID NO: 4748 - DNA, 24 bp, Homo sapiens
aaagctgccagttgaagaactgtt

SEQ ID NO: 4749 - DNA, 18 bp, Homo sapiens
gtgttcagactacctgtt

SEQ ID NO: 4750 - DNA, 19 bp, Homo sapiens
gaggtagtagattgtatag

SEQ ID NO: 4751 - DNA, 23 bp, Homo sapiens
ctctttggttatctagctgtatg

SEQ ID NO: 4752 - DNA, 22 bp, Homo sapiens
ctgggagagggttgtttactcc

SEQ ID NO: 4753 - DNA, 21 bp, Homo sapiens
caagctcgcttctatgggtct

SEQ ID NO: 4754 - DNA, 18 bp, Homo sapiens
gcaccatttgaaatcagt

SEQ ID NO: 4755 - DNA, 20 bp, Homo sapiens
ttctcccaacgtaagcccag

SEQ ID NO: 4756 - DNA, 19 bp, Homo sapiens
cccaatacacggtcgacct

SEQ ID NO: 4757 - DNA, 18 bp, Homo sapiens
accactgaccgttgactg

SEQ ID NO: 4758 - DNA, 21 bp, Homo sapiens
tcggctctgggtctgtgggga

SEQ ID NO: 4759 - DNA, 18 bp, Homo sapiens
gtgcattgctgttgcatt

SEQ ID NO: 4760 - DNA, 24 bp, Homo sapiens
ggcaacaccagtcgatgggctgtc

SEQ ID NO: 4761 - DNA, 22 bp, Homo sapiens
taattttatgtataagctagtc

SEQ ID NO: 4762 - DNA, 20 bp, Homo sapiens
aggtagtaggttgtatagtt

SEQ ID NO: 4763 - DNA, 22 bp, Homo sapiens
tagtaccagtaccttgtgttca

SEQ ID NO: 4764 - DNA, 18 bp, Homo sapiens
agcaccatttgaaatcag

SEQ ID NO: 4765 - DNA, 20 bp, Homo sapiens
cctatatgatgcctttcttc

SEQ ID NO: 4766 - DNA, 21 bp, Homo sapiens
aggagctcacagtctattgag

SEQ ID NO: 4767 - DNA, 18 bp, Homo sapiens
agcttatcagactgatgt

SEQ ID NO: 4768 - DNA, 20 bp, Homo sapiens
atgtctgctgaccatcacct

SEQ ID NO: 4769 - DNA, 20 bp, Homo sapiens
gagtattacatggccaatct

SEQ ID NO: 4770 - DNA, 18 bp, Homo sapiens
gtgtttagactatctgtt

SEQ ID NO: 4771 - DNA, 18 bp, Homo sapiens
tgtctgctgaccatcacc

SEQ ID NO: 4772 - DNA, 20 bp, Homo sapiens
agcaccatttgaaatcagtg

SEQ ID NO: 4773 - DNA, 20 bp, Homo sapiens
cagtgcatcacagaactttg

SEQ ID NO: 4774 - DNA, 19 bp, Homo sapiens
agcaccatttgaaatcagt

SEQ ID NO: 4775 - DNA, 20 bp, Homo sapiens
taatatcggacaaccattgt

SEQ ID NO: 4776 - DNA, 19 bp, Homo sapiens
atgtctgctgaccatcacc

SEQ ID NO: 4777 - DNA, 19 bp, Homo sapiens
ggtagactatggaacgtag

SEQ ID NO: 4778 - DNA, 18 bp, Homo sapiens
aacatccccgactggaag

SEQ ID NO: 4779 - DNA, 23 bp, Homo sapiens
atgattgtagccttttggagtag

SEQ ID NO: 4780 - DNA, 21 bp, Homo sapiens
tcagtttgtcaaataccccaa

SEQ ID NO: 4781 - DNA, 18 bp, Homo sapiens
ctgggagaaggctgttta

SEQ ID NO: 4782 - DNA, 19 bp, Homo sapiens
actagactgaagctccttg

SEQ ID NO: 4783 - DNA, 21 bp, Homo sapiens
gggtattgtttccgctgccag

SEQ ID NO: 4784 - DNA, 22 bp, Homo sapiens
caggggctggctttcctctggt

SEQ ID NO: 4785 - DNA, 22 bp, Homo sapiens
gcgctttgctcagccagtgtag

SEQ ID NO: 4786 - DNA, 20 bp, Homo sapiens
gctacttcacaacaccaggg

SEQ ID NO: 4787 - DNA, 21 bp, Homo sapiens
aatcacattgccagggattac

SEQ ID NO: 4788 - DNA, 20 bp, Homo sapiens
ctgggagagggttgtttact

SEQ ID NO: 4789 - DNA, 20 bp, Homo sapiens
actcactgatcaatgaatgc

SEQ ID NO: 4790 - DNA, 19 bp, Homo sapiens
catcttaccggacagtgct

SEQ ID NO: 4791 - DNA, 20 bp, Homo sapiens
gatcgccgagggccggtcgg

SEQ ID NO: 4792 - DNA, 21 bp, Homo sapiens
agggacgggacgcggtgcagt

SEQ ID NO: 4793 - DNA, 18 bp, Homo sapiens
aagatctcaggcagtgac

SEQ ID NO: 4794 - DNA, 20 bp, Homo sapiens
ctagactgtgagcttctaga

SEQ ID NO: 4795 - DNA, 21 bp, Homo sapiens
aacactgtctggtaaagatgg

SEQ ID NO: 4796 - DNA, 21 bp, Homo sapiens
agtggttttaccctatggtag

SEQ ID NO: 4797 - DNA, 20 bp, Homo sapiens
ctgtagaaccgaatttgtgt

SEQ ID NO: 4798 - DNA, 19 bp, Homo sapiens
tgtaaacatccttgactgg

SEQ ID NO: 4799 - DNA, 19 bp, Homo sapiens
tcagtgcatgacagaactt

SEQ ID NO: 4800 - DNA, 16 bp, Homo sapiens
caggtcgtcttgcagg

SEQ ID NO: 4801 - DNA, 17 bp, Homo sapiens
atggttgaccagagagc

SEQ ID NO: 4802 - DNA, 25 bp, Homo sapiens
ccatagcccggtcgctggtacatga

SEQ ID NO: 4803 - DNA, 21 bp, Homo sapiens
cactgtctggtaaagatggct

SEQ ID NO: 4804 - DNA, 23 bp, Homo sapiens
aaaaactgtaattacttttggac

SEQ ID NO: 4805 - DNA, 18 bp, Homo sapiens
tctacagtgcacgtgtct

SEQ ID NO: 4806 - DNA, 21 bp, Homo sapiens
aggagcttacaatctagctgg

SEQ ID NO: 4807 - DNA, 21 bp, Homo sapiens
cagccacaactaccctgccac

SEQ ID NO: 4808 - DNA, 16 bp, Homo sapiens
agaattgtggctggac

SEQ ID NO: 4809 - DNA, 22 bp, Homo sapiens
aagccaggtcacgtctctgcag

SEQ ID NO: 4810 - DNA, 23 bp, Homo sapiens
agtcagtgcactacagaactttg

SEQ ID NO: 4811 - DNA, 21 bp, Homo sapiens
tgtgcctttggactacatcgt

SEQ ID NO: 4812 - DNA, 20 bp, Homo sapiens
tgtgcctttggactacatcg

SEQ ID NO: 4813 - DNA, 22 bp, Homo sapiens
cacattacacggtcgacctctt

SEQ ID NO: 4814 - DNA, 22 bp, Homo sapiens
aggcagtgtattgctagcggct

SEQ ID NO: 4815 - DNA, 23 bp, Homo sapiens
taggcagtgtattgctagcggct

SEQ ID NO: 4816 - DNA, 19 bp, Homo sapiens
gaggtagtaggttgtatgg

SEQ ID NO: 4817 - DNA, 21 bp, Homo sapiens
taaacatcctacactctcagc

SEQ ID NO: 4818 - DNA, 25 bp, Homo sapiens
gcggggatcgccgagggccggtcgg

SEQ ID NO: 4819 - DNA, 18 bp, Homo sapiens
agatctcaagctgtgact

SEQ ID NO: 4820 - DNA, 19 bp, Homo sapiens
gtagaggagatggcgcagg

SEQ ID NO: 4821 - DNA, 22 bp, Homo sapiens
agggacgggacgcggtgcagtg

SEQ ID NO: 4822 - DNA, 24 bp, Homo sapiens
tttcccagcttgactctaacactg

SEQ ID NO: 4823 - DNA, 23 bp, Homo sapiens
tttcccagcttgactctaacact

SEQ ID NO: 4824 - DNA, 20 bp, Homo sapiens
caacattcattgctgtcggt

SEQ ID NO: 4825 - DNA, 18 bp, Homo sapiens
gtagaggagatggcgcag

SEQ ID NO: 4826 - DNA, 19 bp, Homo sapiens
caacattcattgctgtcgg

SEQ ID NO: 4827 - DNA, 20 bp, Homo sapiens
tggcagtgtattgttagctg

SEQ ID NO: 4828 - DNA, 24 bp, Homo sapiens
ttcacagggaggtgtcatttatgt

SEQ ID NO: 4829 - DNA, 21 bp, Homo sapiens
gaataatacatggttgatctt

SEQ ID NO: 4830 - DNA, 19 bp, Homo sapiens
ggaatcccaaaagcagctg

SEQ ID NO: 4831 - DNA, 24 bp, Homo sapiens
gtttttcattattgctcctgacct

SEQ ID NO: 4832 - DNA, 20 bp, Homo sapiens
acaggcggctgtagcaatgg

SEQ ID NO: 4833 - DNA, 23 bp, Homo sapiens
caacaggcggctgtagcaatggg

SEQ ID NO: 4834 - DNA, 19 bp, Homo sapiens
tgcacttgtcccggcctgt

SEQ ID NO: 4835 - DNA, 19 bp, Homo sapiens
tgccctgtggactcagttc

SEQ ID NO: 4836 - DNA, 22 bp, Homo sapiens
ccatcgtgcggtacttgaagaa

SEQ ID NO: 4837 - DNA, 19 bp, Homo sapiens
gcagtgaaggcacttgtag

SEQ ID NO: 4838 - DNA, 20 bp, Homo sapiens
agagcttagctgattggtga

SEQ ID NO: 4839 - DNA, 25 bp, Homo sapiens
caaaaccatcgaccgttgattgtac

SEQ ID NO: 4840 - DNA, 26 bp, Homo sapiens
caaaaccatcgaccgttgattgtacc

SEQ ID NO: 4841 - DNA, 23 bp, Homo sapiens
ccagccttcagaggactccaagg

SEQ ID NO: 4842 - DNA, 18 bp, Homo sapiens
agtaattcaggataggtt

SEQ ID NO: 4843 - DNA, 18 bp, Homo sapiens
cagcagcaattcatgttt

SEQ ID NO: 4844 - DNA, 21 bp, Homo sapiens
atgcctctgctgctggccaga

SEQ ID NO: 4845 - DNA, 22 bp, Homo sapiens
gctttcagtcggatgtttgcag

SEQ ID NO: 4846 - DNA, 18 bp, Homo sapiens
tcgaccggacctcgaccg

SEQ ID NO: 4847 - DNA, 15 bp, Homo sapiens
ttttgttcgttcggc

SEQ ID NO: 4848 - DNA, 16 bp, Homo sapiens
ttttgttcgttcggct

SEQ ID NO: 4849 - DNA, 22 bp, Homo sapiens
ctctagaggaagcactttctgt

SEQ ID NO: 4850 - DNA, 26 bp, Homo sapiens
aaaagctgggttgagagggcgaaaaa

SEQ ID NO: 4851 - DNA, 23 bp, Homo sapiens
gaacatcacagcaagtctgtgct

SEQ ID NO: 4852 - DNA, 19 bp, Homo sapiens
tattgcacattactaagtt

SEQ ID NO: 4853 - DNA, 21 bp, Homo sapiens
agtgcaatgttaaaagggcat

SEQ ID NO: 4854 - DNA, 20 bp, Homo sapiens
gtaaacatcctacactcagc

SEQ ID NO: 4855 - DNA, 16 bp, Homo sapiens
tggagtgtgacaatgg

SEQ ID NO: 4856 - DNA, 20 bp, Homo sapiens
caaagtgctcatagtgcagg

SEQ ID NO: 4857 - DNA, 21 bp, Homo sapiens
ctatgccaacatattgccatc

SEQ ID NO: 4858 - DNA, 21 bp, Homo sapiens
agcagcacactgtggtttgta

SEQ ID NO: 4859 - DNA, 22 bp, Homo sapiens
ccgggaacgtcgagactggagc

SEQ ID NO: 4860 - DNA, 21 bp, Homo sapiens
ttctctgttttggccatgtgt

SEQ ID NO: 4861 - DNA, 22 bp, Homo sapiens
aagtgctgttcgtgcaggtagt

SEQ ID NO: 4862 - DNA, 20 bp, Homo sapiens
ctcggcgtggcgtcggtcgt

SEQ ID NO: 4863 - DNA, 21 bp, Homo sapiens
acaaacatggtgcacttcttt

SEQ ID NO: 4864 - DNA, 17 bp, Homo sapiens
gtgcttgtccgaggagg

SEQ ID NO: 4865 - DNA, 17 bp, Homo sapiens
taaagctagataaccga

SEQ ID NO: 4866 - DNA, 17 bp, Homo sapiens
ataaagctagataaccg

SEQ ID NO: 4867 - DNA, 25 bp, Homo sapiens
ataaagctagataaccgaaagtaga

SEQ ID NO: 4868 - DNA, 25 bp, Homo sapiens
gtcatttttgtgatgttgcagctag

SEQ ID NO: 4869 - DNA, 19 bp, Homo sapiens
ttggatgagccctcggagg

SEQ ID NO: 4870 - DNA, 19 bp, Homo sapiens
tgttggatgagccctcgga

SEQ ID NO: 4871 - DNA, 17 bp, Homo sapiens
aacattcaacctgtcgg

SEQ ID NO: 4872 - DNA, 25 bp, Homo sapiens
ccgtggcgtccccttccccgccggc

SEQ ID NO: 4873 - DNA, 28 bp, Homo sapiens
tcatggcaacaccagtcgatgggctgtc

SEQ ID NO: 4874 - DNA, 22 bp, Homo sapiens
tttacgttgggagaacttttac

SEQ ID NO: 4875 - DNA, 19 bp, Homo sapiens
ccgttaccattactgagtt

SEQ ID NO: 4876 - DNA, 20 bp, Homo sapiens
atcacattgccagtgattac

SEQ ID NO: 4877 - DNA, 23 bp, Homo sapiens
cagcattgtacagggctatgaaa

SEQ ID NO: 4878 - DNA, 19 bp, Homo sapiens
gtaccgccatgtctgttgg

SEQ ID NO: 4879 - DNA, 22 bp, Homo sapiens
gagcttttggcccgggttatac

SEQ ID NO: 4880 - DNA, 19 bp, Homo sapiens
gaactgaattccataggct

SEQ ID NO: 4881 - DNA, 20 bp, Homo sapiens
ctgctgtttcatacttgagg

SEQ ID NO: 4882 - DNA, 19 bp, Homo sapiens
cgccattatcacactaaat

SEQ ID NO: 4883 - DNA, 18 bp, Homo sapiens
tttggttatctagctgta

SEQ ID NO: 4884 - DNA, 17 bp, Homo sapiens
tagtaggttgtatggtt

SEQ ID NO: 4885 - DNA, 18 bp, Homo sapiens
aacattcattgttgtcgg

SEQ ID NO: 4886 - DNA, 19 bp, Homo sapiens
aggtagtaggttgtatagt

SEQ ID NO: 4887 - DNA, 17 bp, Homo sapiens
ctttggttatctagctg

SEQ ID NO: 4888 - DNA, 17 bp, Homo sapiens
ggtagtaggttgtatgg

SEQ ID NO: 4889 - DNA, 17 bp, Homo sapiens
tagtaggttgtgtggtt

SEQ ID NO: 4890 - DNA, 22 bp, Homo sapiens
gagggagggacgggggctgtgc

SEQ ID NO: 4891 - DNA, 18 bp, Homo sapiens
tctggctccgtgtcttca

SEQ ID NO: 4892 - DNA, 20 bp, Homo sapiens
ctgattcctgggctctgacc

SEQ ID NO: 4893 - DNA, 21 bp, Homo sapiens
tagtcccttccttgaagcggt

SEQ ID NO: 4894 - DNA, 21 bp, Homo sapiens
taggcagtgtagttagctgat

SEQ ID NO: 4895 - DNA, 20 bp, Homo sapiens
ttggggaaacggccgctgag

SEQ ID NO: 4896 - DNA, 20 bp, Homo sapiens
aatcactaaccacacggcca

SEQ ID NO: 4897 - DNA, 19 bp, Homo sapiens
aggcagtgtcattagctga

SEQ ID NO: 4898 - DNA, 21 bp, Homo sapiens
aagaagatctcaggctgtcgt

SEQ ID NO: 4899 - DNA, 21 bp, Homo sapiens
agaagatctcgtgctgtgacc

SEQ ID NO: 4900 - DNA, 19 bp, Homo sapiens
aagatctcgtgctgtgacc

SEQ ID NO: 4901 - DNA, 20 bp, Homo sapiens
gaagatctcgtgctgtgacc

SEQ ID NO: 4902 - DNA, 19 bp, Homo sapiens
caacaaatcccagtctacc

SEQ ID NO: 4903 - DNA, 21 bp, Homo sapiens
gtaactggttgaacaactgaa

SEQ ID NO: 4904 - DNA, 20 bp, Homo sapiens
aacactgtctggtaacgatg

SEQ ID NO: 4905 - DNA, 19 bp, Homo sapiens
agttcttcagtggcaagct

SEQ ID NO: 4906 - DNA, 18 bp, Homo sapiens
ccgaccctgagctctgcc

SEQ ID NO: 4907 - DNA, 24 bp, Homo sapiens
atgattgtagccttttggagtaga

SEQ ID NO: 4908 - DNA, 20 bp, Homo sapiens
tcaacacttgctggtttcct

SEQ ID NO: 4909 - DNA, 20 bp, Homo sapiens
aaaggattctgctgtcggtc

SEQ ID NO: 4910 - DNA, 22 bp, Homo sapiens
caaagttctgagacactccgac

SEQ ID NO: 4911 - DNA, 21 bp, Homo sapiens
tctgtcatttctttaggccaa

SEQ ID NO: 4912 - DNA, 24 bp, Homo sapiens
cattgcacttgtctcggtctgaca

SEQ ID NO: 4913 - DNA, 18 bp, Homo sapiens
gaggaaagaagggagtgg

SEQ ID NO: 4914 - DNA, 18 bp, Homo sapiens
tcgtgtcttgtgttgcag

SEQ ID NO: 4915 - DNA, 17 bp, Homo sapiens
ccgtgagtaataatgcg

SEQ ID NO: 4916 - DNA, 17 bp, Homo sapiens
taccacagggtagaacc

SEQ ID NO: 4917 - DNA, 20 bp, Homo sapiens
agtaccgccatgtctgttgg

SEQ ID NO: 4918 - DNA, 20 bp, Homo sapiens
gtaccgccatgtctgttggg

SEQ ID NO: 4919 - DNA, 20 bp, Homo sapiens
ttgcatatgtaggatgtccc

SEQ ID NO: 4920 - DNA, 18 bp, Homo sapiens
tcgaggactggtggaagg

SEQ ID NO: 4921 - DNA, 19 bp, Homo sapiens
agtcatacacggctctcct

SEQ ID NO: 4922 - DNA, 20 bp, Homo sapiens
tatacaagggcaagctctct

SEQ ID NO: 4923 - DNA, 21 bp, Homo sapiens
aggcagcggggtgtagtggat

SEQ ID NO: 4924 - DNA, 24 bp, Homo sapiens
tatggctttttattcctatgtgat

SEQ ID NO: 4925 - DNA, 24 bp, Homo sapiens
caacaggcggctgtagcaatgggg

SEQ ID NO: 4926 - DNA, 21 bp, Homo sapiens
gatcgccgagggccggtcggc

SEQ ID NO: 4927 - DNA, 25 bp, Homo sapiens
tgaggtagtagtttgtgctgttggt

SEQ ID NO: 4928 - DNA, 20 bp, Homo sapiens
gcaggaacttgtgagtctcc

SEQ ID NO: 4929 - DNA, 29 bp, Homo sapiens
cccaaccagatttcagtggagtgaagttc

SEQ ID NO: 4930 - DNA, 18 bp, Homo sapiens
gcaggaacttgtgagtct

SEQ ID NO: 4931 - DNA, 17 bp, Homo sapiens
ctgtggtagtgaaaagt

SEQ ID NO: 4932 - DNA, 18 bp, Homo sapiens
gttcgttcggctcgcgtg

SEQ ID NO: 4933 - DNA, 19 bp, Homo sapiens
gactagtgattttgttgtt

SEQ ID NO: 4934 - DNA, 17 bp, Homo sapiens
tcgttcggctcgcgtga

SEQ ID NO: 4935 - DNA, 20 bp, Homo sapiens
cctagaatggggattgtggg

SEQ ID NO: 4936 - DNA, 21 bp, Homo sapiens
accgcactgtgggtacttgct

SEQ ID NO: 4937 - DNA, 20 bp, Homo sapiens
tgaactgggaacctgctatg

SEQ ID NO: 4938 - DNA, 21 bp, Homo sapiens
tgaactgggaacctgctatgc

SEQ ID NO: 4939 - DNA, 22 bp, Homo sapiens
ttgaactgggaacctgctatgc

SEQ ID NO: 4940 - DNA, 21 bp, Homo sapiens
ttgaactgggaacctgctatg

SEQ ID NO: 4941 - DNA, 25 bp, Homo sapiens
cggggccgtagcactgtctgagagg

SEQ ID NO: 4942 - DNA, 19 bp, Homo sapiens
acaccagtcgatgggctgt

SEQ ID NO: 4943 - DNA, 19 bp, Homo sapiens
tcctgtactgagctgcccc

SEQ ID NO: 4944 - DNA, 19 bp, Homo sapiens
actagtgattttgttgttg

SEQ ID NO: 4945 - DNA, 24 bp, Homo sapiens
tggagtgtgacaatggtgtttgtg

SEQ ID NO: 4946 - DNA, 17 bp, Homo sapiens
cgaatgttgctcggtga

SEQ ID NO: 4947 - DNA, 20 bp, Homo sapiens
cacgggttaggctcttggga

SEQ ID NO: 4948 - DNA, 18 bp, Homo sapiens
caaagtgctgttcgtgca

SEQ ID NO: 4949 - DNA, 20 bp, Homo sapiens
aagtgctgttcgtgcaggta

SEQ ID NO: 4950 - DNA, 19 bp, Homo sapiens
ctgtactgagctgccccga

SEQ ID NO: 4951 - DNA, 20 bp, Homo sapiens
ctgtactgagctgccccgag

SEQ ID NO: 4952 - DNA, 20 bp, Homo sapiens
aacgcacttccctttagagt

SEQ ID NO: 4953 - DNA, 19 bp, Homo sapiens
tatggcttttcattcctat

SEQ ID NO: 4954 - DNA, 24 bp, Homo sapiens
catagcccggtcgctggtacatga

SEQ ID NO: 4955 - DNA, 18 bp, Homo sapiens
ccaccttctccacccagc

SEQ ID NO: 4956 - DNA, 20 bp, Homo sapiens
aagtgctgacagtgcagata

SEQ ID NO: 4957 - DNA, 17 bp, Homo sapiens
tgaattccataggctgt

SEQ ID NO: 4958 - DNA, 23 bp, Homo sapiens
gctgactcctagtccagggctcg

SEQ ID NO: 4959 - DNA, 19 bp, Homo sapiens
aactggttgaacaactgaa

SEQ ID NO: 4960 - DNA, 19 bp, Homo sapiens
ctttttgcggtctgggctt

SEQ ID NO: 4961 - DNA, 19 bp, Homo sapiens
ttcactggagtttgtttca

SEQ ID NO: 4962 - DNA, 17 bp, Homo sapiens
ttctcgaggaaagaagc

SEQ ID NO: 4963 - DNA, 26 bp, Homo sapiens
catcttaccggacagtgctggatttc

SEQ ID NO: 4964 - DNA, 19 bp, Homo sapiens
aaacatccccgactggaag

SEQ ID NO: 4965 - DNA, 29 bp, Homo sapiens
tgtaaacatccccgactggaagctgtaag

SEQ ID NO: 4966 - DNA, 21 bp, Homo sapiens
ttcttcatgtgactcgtggac

SEQ ID NO: 4967 - DNA, 22 bp, Homo sapiens
gctgccaattccataggtcaca

SEQ ID NO: 4968 - DNA, 19 bp, Homo sapiens
gagcaataacgaaaaatgt

SEQ ID NO: 4969 - DNA, 22 bp, Homo sapiens
cgtaccgtgagtaataatgcgc

SEQ ID NO: 4970 - DNA, 20 bp, Homo sapiens
ttgaaacaatctctactgaa

SEQ ID NO: 4971 - DNA, 19 bp, Homo sapiens
tgctggatcagtggttcga

SEQ ID NO: 4972 - DNA, 17 bp, Homo sapiens
atgacctatgaattgac

SEQ ID NO: 4973 - DNA, 22 bp, Homo sapiens
ttttcctatgcatatacttctt

SEQ ID NO: 4974 - DNA, 20 bp, Homo sapiens
ttcactggagtttgtttcaa

SEQ ID NO: 4975 - DNA, 21 bp, Homo sapiens
tccttgactggaagctgtaag

SEQ ID NO: 4976 - DNA, 25 bp, Homo sapiens
cctcaaatgtggagcactattctga

SEQ ID NO: 4977 - DNA, 21 bp, Homo sapiens
aacgcacttccctttagagtg

SEQ ID NO: 4978 - DNA, 20 bp, Homo sapiens
aacatcctacactctcagct

SEQ ID NO: 4979 - DNA, 20 bp, Homo sapiens
aacatccccgactggaagct

SEQ ID NO: 4980 - DNA, 19 bp, Homo sapiens
aacatccccgactggaagc

SEQ ID NO: 4981 - DNA, 18 bp, Homo sapiens
aacatcctacactcagct

SEQ ID NO: 4982 - DNA, 19 bp, Homo sapiens
aacatccttgactggaagc

SEQ ID NO: 4983 - DNA, 20 bp, Homo sapiens
ttttcctgggatttgggagc

SEQ ID NO: 4984 - DNA, 23 bp, Homo sapiens
gctgccaattccataggtcacag

SEQ ID NO: 4985 - DNA, 20 bp, Homo sapiens
aacgcgcttccctatagagg

SEQ ID NO: 4986 - DNA, 21 bp, Homo sapiens
gggcttagctgcttgtgagca

SEQ ID NO: 4987 - DNA, 20 bp, Homo sapiens
tgagacctctgggttctgag

SEQ ID NO: 4988 - DNA, 22 bp, Homo sapiens
catgcctctgctgctggccaga

SEQ ID NO: 4989 - DNA, 22 bp, Homo sapiens
aaagtgctcatagtgcaggtag

SEQ ID NO: 4990 - DNA, 20 bp, Homo sapiens
aatggttccctttagagtgt

SEQ ID NO: 4991 - DNA, 21 bp, Homo sapiens
aaatggttccctttagagtgt

SEQ ID NO: 4992 - DNA, 16 bp, Homo sapiens
actctagagggaagcg

SEQ ID NO: 4993 - DNA, 16 bp, Homo sapiens
catccccgactggaag

SEQ ID NO: 4994 - DNA, 21 bp, Homo sapiens
cagtggggctgctgttatctg

SEQ ID NO: 4995 - DNA, 19 bp, Homo sapiens
gattcctggaaatactgtt

SEQ ID NO: 4996 - DNA, 21 bp, Homo sapiens
gaagcccttaccccaaaaagt

SEQ ID NO: 4997 - DNA, 22 bp, Homo sapiens
gaaggcgcttccctttggagtg

SEQ ID NO: 4998 - DNA, 22 bp, Homo sapiens
agtggatgatgcactctgtgca

SEQ ID NO: 4999 - DNA, 23 bp, Homo sapiens
tagtggatgatgcactctgtgca

SEQ ID NO: 5000 - DNA, 21 bp, Homo sapiens
ccattacactaccctgcctct

SEQ ID NO: 5001 - DNA, 23 bp, Homo sapiens
accaatattactgtgctgcttta

SEQ ID NO: 5002 - DNA, 22 bp, Homo sapiens
cattcaacgctgtcggtgagtt

SEQ ID NO: 5003 - DNA, 17 bp, Homo sapiens
caacgctgtcggtgagt

SEQ ID NO: 5004 - DNA, 17 bp, Homo sapiens
gtgtgacaatggtgttt

SEQ ID NO: 5005 - DNA, 22 bp, Homo sapiens
tcttgagggaagcactttctgt

SEQ ID NO: 5006 - DNA, 17 bp, Homo sapiens
ctctacagggaagcgct

SEQ ID NO: 5007 - DNA, 20 bp, Homo sapiens
aaagcgcttccctttgctgg

SEQ ID NO: 5008 - DNA, 20 bp, Homo sapiens
caagtcaggctcttgggacc

SEQ ID NO: 5009 - DNA, 20 bp, Homo sapiens
cggggccgtagcactgtctg

SEQ ID NO: 5010 - DNA, 23 bp, Homo sapiens
gcattgcacttgtctcggtctga

SEQ ID NO: 5011 - DNA, 18 bp, Homo sapiens
cggctctgggtctgtggg

SEQ ID NO: 5012 - DNA, 21 bp, Homo sapiens
tcgggaatgtcgtgtccgccc

SEQ ID NO: 5013 - DNA, 20 bp, Homo sapiens
gcagcaattcatgttttgaa

SEQ ID NO: 5014 - DNA, 25 bp, Homo sapiens
atactgcatcaggaactgattggat

SEQ ID NO: 5015 - DNA, 20 bp, Homo sapiens
taatctcagctggcaactgt

SEQ ID NO: 5016 - DNA, 23 bp, Homo sapiens
ttaatctcagctggcaactgtga

SEQ ID NO: 5017 - DNA, 21 bp, Homo sapiens
acagtggtctctgggattatg

SEQ ID NO: 5018 - DNA, 18 bp, Homo sapiens
cctctgggcccttcctcc

SEQ ID NO: 5019 - DNA, 24 bp, Homo sapiens
tggctcagttcagcaggaacagga

SEQ ID NO: 5020 - DNA, 24 bp, Homo sapiens
tgctatgccaacatattgccatct

SEQ ID NO: 5021 - DNA, 20 bp, Homo sapiens
atcccaccactgccaccatt

SEQ ID NO: 5022 - DNA, 21 bp, Homo sapiens
cctattcttgattacttgttt

SEQ ID NO: 5023 - DNA, 23 bp, Homo sapiens
cattcaacgctgtcggtgagttt

SEQ ID NO: 5024 - DNA, 20 bp, Homo sapiens
tttcattattgctcctgacc

SEQ ID NO: 5025 - DNA, 21 bp, Homo sapiens
ctgtaaacgctttctgatgta

SEQ ID NO: 5026 - DNA, 21 bp, Homo sapiens
actcctctcctcccgtcttct

SEQ ID NO: 5027 - DNA, 26 bp, Homo sapiens
aagacgggaggaaagaagggagtggt

SEQ ID NO: 5028 - DNA, 30 bp, Homo sapiens
atgaatgaattcatgatactgtaaacgctt

SEQ ID NO: 5029 - DNA, 20 bp, Homo sapiens
ttaagacttgcagtgatgtt

SEQ ID NO: 5030 - DNA, 19 bp, Homo sapiens
tccattacactaccctgcc

SEQ ID NO: 5031 - DNA, 25 bp, Homo sapiens
ttgtgaaatgtttaggaccactaga

SEQ ID NO: 5032 - DNA, 19 bp, Homo sapiens
agaagatctcaggctgtgt

SEQ ID NO: 5033 - DNA, 16 bp, Homo sapiens
gaattccataggctgt

SEQ ID NO: 5034 - DNA, 18 bp, Homo sapiens
ctcttgagggaagcactt

SEQ ID NO: 5035 - DNA, 24 bp, Homo sapiens
gtaaacatcctcgactggaagctg

SEQ ID NO: 5036 - DNA, 22 bp, Homo sapiens
agcgcgggctgagcgctgccag

SEQ ID NO: 5037 - DNA, 20 bp, Homo sapiens
tcagtcggatgtttgcagct

SEQ ID NO: 5038 - DNA, 19 bp, Homo sapiens
actctgggtacctgagaag

SEQ ID NO: 5039 - DNA, 19 bp, Homo sapiens
ttgaaacaatctctactga

SEQ ID NO: 5040 - DNA, 17 bp, Homo sapiens
ttcagtcggatgtttgc

SEQ ID NO: 5041 - DNA, 25 bp, Homo sapiens
gaatgttgctcggtgaacccctttt

SEQ ID NO: 5042 - DNA, 24 bp, Homo sapiens
tggagacgcggccctgttggagta

SEQ ID NO: 5043 - DNA, 20 bp, Homo sapiens
agtattacatggccaatctc

SEQ ID NO: 5044 - DNA, 18 bp, Homo sapiens
ttacactaccctgcctct

SEQ ID NO: 5045 - DNA, 21 bp, Homo sapiens
acaaatctccggaccacttag

SEQ ID NO: 5046 - DNA, 21 bp, Homo sapiens
atggtcgaccagttggaaagt

SEQ ID NO: 5047 - DNA, 23 bp, Homo sapiens
gagcaagatctcaggctgtgacc

SEQ ID NO: 5048 - DNA, 19 bp, Homo sapiens
actgaccgttgactgtacc

SEQ ID NO: 5049 - DNA, 24 bp, Homo sapiens
actgctgagctagcacttcccgag

SEQ ID NO: 5050 - DNA, 23 bp, Homo sapiens
aaagtgctgacagtgcagatagt

SEQ ID NO: 5051 - DNA, 24 bp, Homo sapiens
ccaaagtgctgttcgtgcaggtag

SEQ ID NO: 5052 - DNA, 21 bp, Homo sapiens
tagcagcgggaacagttctgc

SEQ ID NO: 5053 - DNA, 25 bp, Homo sapiens
ttatcagactgatgttgactgttga

SEQ ID NO: 5054 - DNA, 20 bp, Homo sapiens
atagtagaccgtatagcgta

SEQ ID NO: 5055 - DNA, 24 bp, Homo sapiens
tttgtgacctggtccactaaccct

SEQ ID NO: 5056 - DNA, 19 bp, Homo sapiens
ctgccctggcccgagggac

SEQ ID NO: 5057 - DNA, 22 bp, Homo sapiens
actgtgcgtgtgacagcggctg

SEQ ID NO: 5058 - DNA, 23 bp, Homo sapiens
agcctggaagctggagcctgcag

SEQ ID NO: 5059 - DNA, 22 bp, Homo sapiens
atccccgactggaagctgtaag

SEQ ID NO: 5060 - DNA, 20 bp, Homo sapiens
gtaaacatcctacactctca

SEQ ID NO: 5061 - DNA, 21 bp, Homo sapiens
gtaaacatcctacactctcag

SEQ ID NO: 5062 - DNA, 19 bp, Homo sapiens
gaatatctcaggctgtgac

SEQ ID NO: 5063 - DNA, 25 bp, Homo sapiens
tcttggagtaggtcattgggtggat

SEQ ID NO: 5064 - DNA, 18 bp, Homo sapiens
taaggcacgcggtgaatg

SEQ ID NO: 5065 - DNA, 21 bp, Homo sapiens
ttctccaaaagggagcacttt

SEQ ID NO: 5066 - DNA, 24 bp, Homo sapiens
ggccgccccgggtgccgcgcggtg

SEQ ID NO: 5067 - DNA, 22 bp, Homo sapiens
gtggatattccttctatgttta

SEQ ID NO: 5068 - DNA, 22 bp, Homo sapiens
gcgaggttgccctttgtatatt

SEQ ID NO: 5069 - DNA, 23 bp, Homo sapiens
catcttactgggcagcattggat

SEQ ID NO: 5070 - DNA, 21 bp, Homo sapiens
aagtcactagtggttccgttt

SEQ ID NO: 5071 - DNA, 23 bp, Homo sapiens
tggcaatggtagaactcacactg

SEQ ID NO: 5072 - DNA, 18 bp, Homo sapiens
attcctggaaatactgtt

SEQ ID NO: 5073 - DNA, 20 bp, Homo sapiens
ctccagcatcagtgattttg

SEQ ID NO: 5074 - DNA, 22 bp, Homo sapiens
aggttgtccgtgttgtcttctc

SEQ ID NO: 5075 - DNA, 20 bp, Homo sapiens
ccaatattggctgtgctgct

SEQ ID NO: 5076 - DNA, 21 bp, Homo sapiens
atattaccattagctcatctt

SEQ ID NO: 5077 - DNA, 21 bp, Homo sapiens
tcctcttctccctcctcccag

SEQ ID NO: 5078 - DNA, 23 bp, Homo sapiens
gtcggccgcgctcgaggggtccc

SEQ ID NO: 5079 - DNA, 18 bp, Homo sapiens
gaagatctcaggctgtga

SEQ ID NO: 5080 - DNA, 22 bp, Homo sapiens
gaaagtgcttccttttagaggc

SEQ ID NO: 5081 - DNA, 21 bp, Homo sapiens
ctggatggctcctccatgtct

SEQ ID NO: 5082 - DNA, 23 bp, Homo sapiens
aaatctctgcaggcaaatgtgat

SEQ ID NO: 5083 - DNA, 16 bp, Homo sapiens
ctatacgacctgctgc

SEQ ID NO: 5084 - DNA, 20 bp, Homo sapiens
aagtgaagctcaggctgtga

SEQ ID NO: 5085 - DNA, 24 bp, Homo sapiens
aatgttgctcggtgaacccctttt

SEQ ID NO: 5086 - DNA, 16 bp, Homo sapiens
tgtaccaccttgtcgg

SEQ ID NO: 5087 - DNA, 22 bp, Homo sapiens
atggtcgaccagttggaaagta

SEQ ID NO: 5088 - DNA, 21 bp, Homo sapiens
tcaagtaatccaggataggct

SEQ ID NO: 5089 - DNA, 21 bp, Homo sapiens
ccaggtcacgtctctgcagtt

SEQ ID NO: 5090 - DNA, 19 bp, Homo sapiens
cagtccatgggcatataca

SEQ ID NO: 5091 - DNA, 20 bp, Homo sapiens
gagggttgggtggaggctct

SEQ ID NO: 5092 - DNA, 21 bp, Homo sapiens
ttagggccctggctccatctc

SEQ ID NO: 5093 - DNA, 20 bp, Homo sapiens
tttcaagccagggggcgttt

SEQ ID NO: 5094 - DNA, 20 bp, Homo sapiens
gcgtccccttccccgccggc

SEQ ID NO: 5095 - DNA, 22 bp, Homo sapiens
gaagcattctttcattggttgg

SEQ ID NO: 5096 - DNA, 19 bp, Homo sapiens
gcgacccatacttggtttc

SEQ ID NO: 5097 - DNA, 21 bp, Homo sapiens
tggttatccctgtcctgttcg

SEQ ID NO: 5098 - DNA, 21 bp, Homo sapiens
caatttagtgtgtgtgatatt

SEQ ID NO: 5099 - DNA, 18 bp, Homo sapiens
ttcatgtgactcgtggac

SEQ ID NO: 5100 - DNA, 24 bp, Homo sapiens
tgccctgtggactcagttctggtg

SEQ ID NO: 5101 - DNA, 21 bp, Homo sapiens
tccctttgtcatcctatgcct

SEQ ID NO: 5102 - DNA, 21 bp, Homo sapiens
caacaaaatcactgatgctgg

SEQ ID NO: 5103 - DNA, 23 bp, Homo sapiens
aaagcacctccagagcttgaagc

SEQ ID NO: 5104 - DNA, 22 bp, Homo sapiens
ctggctccgtgtcttcactccc

SEQ ID NO: 5105 - DNA, 18 bp, Homo sapiens
tgctgttcgtgcaggtag

SEQ ID NO: 5106 - DNA, 17 bp, Homo sapiens
acatcctacactctcag

SEQ ID NO: 5107 - DNA, 20 bp, Homo sapiens
atcttactgggcagcattgg

SEQ ID NO: 5108 - DNA, 23 bp, Homo sapiens
gcgacgagcccctcgcacaaacc

SEQ ID NO: 5109 - DNA, 20 bp, Homo sapiens
agacgggaggaaagaaggga

SEQ ID NO: 5110 - DNA, 17 bp, Homo sapiens
ctgtgcgtgtgacagcg

SEQ ID NO: 5111 - DNA, 23 bp, Homo sapiens
tcacagtgaaccggtctctttcc

SEQ ID NO: 5112 - DNA, 19 bp, Homo sapiens
gtcaacacttgctggtttc

SEQ ID NO: 5113 - DNA, 23 bp, Homo sapiens
ccaacaatatcctggtgctgagt

SEQ ID NO: 5114 - DNA, 22 bp, Homo sapiens
ccaacaatatcctggtgctgag

SEQ ID NO: 5115 - DNA, 21 bp, Homo sapiens
aatcatacagggacatccagt

SEQ ID NO: 5116 - DNA, 22 bp, Homo sapiens
atcttactgggcagcattggat

SEQ ID NO: 5117 - DNA, 19 bp, Homo sapiens
tgaaggtctactgtgtgcc

SEQ ID NO: 5118 - DNA, 21 bp, Homo sapiens
ctgctggggtggaacctggtc

SEQ ID NO: 5119 - DNA, 20 bp, Homo sapiens
atatgtctgctgaccatcac

SEQ ID NO: 5120 - DNA, 21 bp, Homo sapiens
gatcgaccgtgttatattcgc

SEQ ID NO: 5121 - DNA, 19 bp, Homo sapiens
aacatagaggaaattccac

SEQ ID NO: 5122 - DNA, 19 bp, Homo sapiens
ctcgtgtcttgtgttgcag

SEQ ID NO: 5123 - DNA, 26 bp, Homo sapiens
gtgtggtcaggcggctcggactgagc

SEQ ID NO: 5124 - DNA, 20 bp, Homo sapiens
tgcagtgaaggcacttgtag

SEQ ID NO: 5125 - DNA, 23 bp, Homo sapiens
aggcagtgtattgctagcggctg

SEQ ID NO: 5126 - DNA, 16 bp, Homo sapiens
gtgaaatgtttaggac

SEQ ID NO: 5127 - DNA, 19 bp, Homo sapiens
cagtctacagccatggtcg

SEQ ID NO: 5128 - DNA, 20 bp, Homo sapiens
cgtggctttcgattgttact

SEQ ID NO: 5129 - DNA, 20 bp, Homo sapiens
acagtctacagccatggtcg

SEQ ID NO: 5130 - DNA, 21 bp, Homo sapiens
ccgtggctttcgattgttact

SEQ ID NO: 5131 - DNA, 23 bp, Homo sapiens
aaaatctctgcaggcaaatgtga

SEQ ID NO: 5132 - DNA, 20 bp, Homo sapiens
aaaagctgggttgagagggt

SEQ ID NO: 5133 - DNA, 19 bp, Homo sapiens
acgggttaggctcttggga

SEQ ID NO: 5134 - DNA, 20 bp, Homo sapiens
ttagggccctggctccatct

SEQ ID NO: 5135 - DNA, 24 bp, Homo sapiens
ttggcagtgtcttagctggttgtt

SEQ ID NO: 5136 - DNA, 21 bp, Homo sapiens
gtgcctgagggagtaagagcc

SEQ ID NO: 5137 - DNA, 23 bp, Homo sapiens
tgtcactcggctcggcccactac

SEQ ID NO: 5138 - DNA, 19 bp, Homo sapiens
cagggtagaaccacggaca

SEQ ID NO: 5139 - DNA, 19 bp, Homo sapiens
tcaagagcaataacgaaaa

SEQ ID NO: 5140 - DNA, 21 bp, Homo sapiens
tggccctctctgcccttccgt

SEQ ID NO: 5141 - DNA, 23 bp, Homo sapiens
atcggatccgtctgagcttggct

SEQ ID NO: 5142 - DNA, 30 bp, Homo sapiens
gtggccctgactgaagaccagcagttgtac

SEQ ID NO: 5143 - DNA, 20 bp, Homo sapiens
gtgcctactgagctgaaaca

SEQ ID NO: 5144 - DNA, 22 bp, Homo sapiens
ttggagtaggtcattgggtgga

SEQ ID NO: 5145 - DNA, 24 bp, Homo sapiens
ttatcagaatctccaggggtactt

SEQ ID NO: 5146 - DNA, 20 bp, Homo sapiens
tcacaagtcaggctcttggg

SEQ ID NO: 5147 - DNA, 23 bp, Homo sapiens
aactggttgaacaactgaaccca

SEQ ID NO: 5148 - DNA, 20 bp, Homo sapiens
ggactatagaactttccccc

SEQ ID NO: 5149 - DNA, 18 bp, Homo sapiens
aaaccagacttttcctag

SEQ ID NO: 5150 - DNA, 19 bp, Homo sapiens
caagtcaggctcttgggac

SEQ ID NO: 5151 - DNA, 19 bp, Homo sapiens
ggactatagaactttcccc

SEQ ID NO: 5152 - DNA, 20 bp, Homo sapiens
ccaatacacggtcgacctct

SEQ ID NO: 5153 - DNA, 22 bp, Homo sapiens
cttgagccctccctctctcatc

SEQ ID NO: 5154 - DNA, 23 bp, Homo sapiens
gcaagaagatctcaggctgtgac

SEQ ID NO: 5155 - DNA, 22 bp, Homo sapiens
aagaagatctcaagctgtgggt

SEQ ID NO: 5156 - DNA, 23 bp, Homo sapiens
caagaagatctcaagctgtgggt

SEQ ID NO: 5157 - DNA, 26 bp, Homo sapiens
ttatcagactgatgttgactgttgaa

SEQ ID NO: 5158 - DNA, 21 bp, Homo sapiens
ggacggagaactgataagggt

SEQ ID NO: 5159 - DNA, 20 bp, Homo sapiens
cactgtgtcctttctgcgta

SEQ ID NO: 5160 - DNA, 24 bp, Homo sapiens
tcagaacaaatgccggttcccaga

SEQ ID NO: 5161 - DNA, 18 bp, Homo sapiens
cactcctctcctcccgtc

SEQ ID NO: 5162 - DNA, 23 bp, Homo sapiens
aatcatacagggacatccagttt

SEQ ID NO: 5163 - DNA, 21 bp, Homo sapiens
tgcacccaggcaaggattctg

SEQ ID NO: 5164 - DNA, 20 bp, Homo sapiens
taaatttcacctttctgaga

SEQ ID NO: 5165 - DNA, 20 bp, Homo sapiens
ggtagtttcatgttgttggg

SEQ ID NO: 5166 - DNA, 19 bp, Homo sapiens
aaaggattctgctgtcggt

SEQ ID NO: 5167 - DNA, 25 bp, Homo sapiens
agatgggctttcagtcggatgtttg

SEQ ID NO: 5168 - DNA, 24 bp, Homo sapiens
cctccaaagggaagcgctttctgt

SEQ ID NO: 5169 - DNA, 21 bp, Homo sapiens
ttcacaaggaggtgtcattta

SEQ ID NO: 5170 - DNA, 21 bp, Homo sapiens
atcacaagtcaggctcttggg

SEQ ID NO: 5171 - DNA, 21 bp, Homo sapiens
gattgacacttctgtgagtag

SEQ ID NO: 5172 - DNA, 19 bp, Homo sapiens
aaagtgcttccttttagag

SEQ ID NO: 5173 - DNA, 21 bp, Homo sapiens
tggactgagccgtgctactgg

SEQ ID NO: 5174 - DNA, 22 bp, Homo sapiens
taaatttcacctttctgagaag

SEQ ID NO: 5175 - DNA, 19 bp, Homo sapiens
aggcagtgtattgctagcg

SEQ ID NO: 5176 - DNA, 26 bp, Homo sapiens
cggacaggcgttcgtgcgacgtgtgg

SEQ ID NO: 5177 - DNA, 19 bp, Homo sapiens
cattcattgctgtcggtgg

SEQ ID NO: 5178 - DNA, 18 bp, Homo sapiens
ccggtcgctggtacatga

SEQ ID NO: 5179 - DNA, 22 bp, Homo sapiens
aagaagatctcaggctgtgacc

SEQ ID NO: 5180 - DNA, 23 bp, Homo sapiens
cctccaaagggaagcgctttctg

SEQ ID NO: 5181 - DNA, 25 bp, Homo sapiens
aaagcacctccagagcttgaagctc

SEQ ID NO: 5182 - DNA, 22 bp, Homo sapiens
catcgtgcggtacttgaagaaa

SEQ ID NO: 5183 - DNA, 18 bp, Homo sapiens
aatatctcaggctgtgac

SEQ ID NO: 5184 - DNA, 23 bp, Homo sapiens
aatataacacagatggcctgttt

SEQ ID NO: 5185 - DNA, 23 bp, Homo sapiens
tgctgacgtgcggtacttaatga

SEQ ID NO: 5186 - DNA, 20 bp, Homo sapiens
aggcagtgtattgctagcgg

SEQ ID NO: 5187 - DNA, 17 bp, Homo sapiens
tgtttaggaccactaga

SEQ ID NO: 5188 - DNA, 20 bp, Homo sapiens
aaagatctggaagtgggaga

SEQ ID NO: 5189 - DNA, 22 bp, Homo sapiens
atacacatacacgcaacacaca

SEQ ID NO: 5190 - DNA, 22 bp, Homo sapiens
acctcctgtgtgcatggattac

SEQ ID NO: 5191 - DNA, 19 bp, Homo sapiens
tacgtcatcgttgtcatcg

SEQ ID NO: 5192 - DNA, 25 bp, Homo sapiens
cagatcagaaggtgattgtggcttt

SEQ ID NO: 5193 - DNA, 19 bp, Homo sapiens
ctgtggactcagttctggt

SEQ ID NO: 5194 - DNA, 24 bp, Homo sapiens
tcgaccggacctcgaccggctcgt

SEQ ID NO: 5195 - DNA, 19 bp, Homo sapiens
tcgtacagggtcatccact

SEQ ID NO: 5196 - DNA, 22 bp, Homo sapiens
aagtgcttcctttttgagggtt

SEQ ID NO: 5197 - DNA, 22 bp, Homo sapiens
gaaagcgcttccttttagagga

SEQ ID NO: 5198 - DNA, 24 bp, Homo sapiens
aaagcacctccagagcttgaagct

SEQ ID NO: 5199 - DNA, 18 bp, Homo sapiens
tgcattgctgttgcattg

SEQ ID NO: 5200 - DNA, 22 bp, Homo sapiens
caatggtagaactcacactggt

SEQ ID NO: 5201 - DNA, 20 bp, Homo sapiens
ttttgcaatatgttcctgaa

SEQ ID NO: 5202 - DNA, 16 bp, Homo sapiens
ggttatctagctgtat

SEQ ID NO: 5203 - DNA, 22 bp, Homo sapiens
ggatcgccgagggccggtcggc

SEQ ID NO: 5204 - DNA, 22 bp, Homo sapiens
gtgcacccaggcaaggattctg

SEQ ID NO: 5205 - DNA, 20 bp, Homo sapiens
gtgggttggggcgggctctg

SEQ ID NO: 5206 - DNA, 23 bp, Homo sapiens
ccgaccctgagctctgccaccga

SEQ ID NO: 5207 - DNA, 20 bp, Homo sapiens
gcaagatgctggcatagctg

SEQ ID NO: 5208 - DNA, 22 bp, Homo sapiens
tgatatgtttgatatattaggt

SEQ ID NO: 5209 - DNA, 22 bp, Homo sapiens
agcgaggttgccctttgtatat

SEQ ID NO: 5210 - DNA, 21 bp, Homo sapiens
ttcatttatccccagcctaca

SEQ ID NO: 5211 - DNA, 17 bp, Homo sapiens
gtttcctactttatgga

SEQ ID NO: 5212 - DNA, 27 bp, Homo sapiens
caggtcacgtctctgcagttacacagc

SEQ ID NO: 5213 - DNA, 23 bp, Homo sapiens
tgagtattacatggccaatctcc

SEQ ID NO: 5214 - DNA, 30 bp, Homo sapiens
tgagaactgaattccataggctgtgagctc

SEQ ID NO: 5215 - DNA, 22 bp, Homo sapiens
attgggaacattttgcatgtat

SEQ ID NO: 5216 - DNA, 30 bp, Homo sapiens
tacccattgcatatcggagttgtgaattct

SEQ ID NO: 5217 - DNA, 23 bp, Homo sapiens
acaggcgttcgtgcgacgtgtgg

SEQ ID NO: 5218 - DNA, 20 bp, Homo sapiens
cattcattgctgtcggtggg

SEQ ID NO: 5219 - DNA, 20 bp, Homo sapiens
aaccatcgaccgttgattgt

SEQ ID NO: 5220 - DNA, 18 bp, Homo sapiens
tgtcttgcaggccgtcat

SEQ ID NO: 5221 - DNA, 17 bp, Homo sapiens
tgtcttgcaggccgtca

SEQ ID NO: 5222 - DNA, 19 bp, Homo sapiens
tggactgagccgtgctact

SEQ ID NO: 5223 - DNA, 20 bp, Homo sapiens
tggactgagccgtgctactg

SEQ ID NO: 5224 - DNA, 24 bp, Homo sapiens
aggcaagatgctggcatagctgtt

SEQ ID NO: 5225 - DNA, 17 bp, Homo sapiens
atccccagatacaatgg

SEQ ID NO: 5226 - DNA, 23 bp, Homo sapiens
caaagtgcttacagtgcaggtag

SEQ ID NO: 5227 - DNA, 20 bp, Homo sapiens
aacagtctacagccatggtc

SEQ ID NO: 5228 - DNA, 21 bp, Homo sapiens
gaaatcgcttccctttggagt

SEQ ID NO: 5229 - DNA, 20 bp, Homo sapiens
atggtgggccgcagaacatg

SEQ ID NO: 5230 - DNA, 19 bp, Homo sapiens
tggtgggccgcagaacatg

SEQ ID NO: 5231 - DNA, 18 bp, Homo sapiens
tactcaaaaagctgtcag

SEQ ID NO: 5232 - DNA, 22 bp, Homo sapiens
gtgccgccatcttttgagtgtt

SEQ ID NO: 5233 - DNA, 21 bp, Homo sapiens
agtgcaatgatgaaagggcat

SEQ ID NO: 5234 - DNA, 21 bp, Homo sapiens
ggtccagttttcccaggaatc

SEQ ID NO: 5235 - DNA, 22 bp, Homo sapiens
ccagtggagatgctgttacttt

SEQ ID NO: 5236 - DNA, 19 bp, Homo sapiens
ctgcaaagggaagcccttt

SEQ ID NO: 5237 - DNA, 20 bp, Homo sapiens
accaccgccggccgatgggc

SEQ ID NO: 5238 - DNA, 23 bp, Homo sapiens
agaggtatagggcatgggaaaac

SEQ ID NO: 5239 - DNA, 24 bp, Homo sapiens
aagctgggttgagagggcgaaaaa

SEQ ID NO: 5240 - DNA, 17 bp, Homo sapiens
tccctgagaccctaact

SEQ ID NO: 5241 - DNA, 21 bp, Homo sapiens
catctcactgtagcctcgaac

SEQ ID NO: 5242 - DNA, 23 bp, Homo sapiens
atgcaccatggttgtctgagcat

SEQ ID NO: 5243 - DNA, 17 bp, Homo sapiens
gcactacagaactttgt

SEQ ID NO: 5244 - DNA, 18 bp, Homo sapiens
tcgaccgttgattgtacc

SEQ ID NO: 5245 - DNA, 24 bp, Homo sapiens
cgcatcccctagggcattggtgta

SEQ ID NO: 5246 - DNA, 17 bp, Homo sapiens
ggtagtaggttgtatag

SEQ ID NO: 5247 - DNA, 20 bp, Homo sapiens
atcggatccgtctgagcttg

SEQ ID NO: 5248 - DNA, 22 bp, Homo sapiens
cggccccacgcaccagggtaag

SEQ ID NO: 5249 - DNA, 17 bp, Homo sapiens
tcactcctctcctcccg

SEQ ID NO: 5250 - DNA, 20 bp, Homo sapiens
tcatgatgggctcctcggtg

SEQ ID NO: 5251 - DNA, 22 bp, Homo sapiens
gcaggtcgtcttgcagggcttc

SEQ ID NO: 5252 - DNA, 18 bp, Homo sapiens
tggatgagccctcggagg

SEQ ID NO: 5253 - DNA, 19 bp, Homo sapiens
tactctggagagtgacaat

SEQ ID NO: 5254 - DNA, 18 bp, Homo sapiens
actccatttgttttgatg

SEQ ID NO: 5255 - DNA, 20 bp, Homo sapiens
ctgtctcagagcctggagtg

SEQ ID NO: 5256 - DNA, 19 bp, Homo sapiens
ctgtacagcctcctagctt

SEQ ID NO: 5257 - DNA, 19 bp, Homo sapiens
ctcggcgtggcgtcggtcg

SEQ ID NO: 5258 - DNA, 21 bp, Homo sapiens
ctcactgatcaatgaatgcaa

SEQ ID NO: 5259 - DNA, 19 bp, Homo sapiens
gtgtgacaatggtgtttgt

SEQ ID NO: 5260 - DNA, 21 bp, Homo sapiens
caccaccgccggccgatgggc

SEQ ID NO: 5261 - DNA, 18 bp, Homo sapiens
ttccctttgtcatcctat

SEQ ID NO: 5262 - DNA, 16 bp, Homo sapiens
cagtcgatgggctgtc

SEQ ID NO: 5263 - DNA, 22 bp, Homo sapiens
gtgggcgggggcaggtgtgtgg

SEQ ID NO: 5264 - DNA, 21 bp, Homo sapiens
tatagggattggagccgtggc

SEQ ID NO: 5265 - DNA, 21 bp, Homo sapiens
gacgttggctctggtggtgat

SEQ ID NO: 5266 - DNA, 22 bp, Homo sapiens
taccctgtagatccgaatttgt

SEQ ID NO: 5267 - DNA, 18 bp, Homo sapiens
gaattctccttttgggct

SEQ ID NO: 5268 - DNA, 19 bp, Homo sapiens
caccctgcccgggacccag

SEQ ID NO: 5269 - DNA, 20 bp, Homo sapiens
aacaaacatggtgcacttct

SEQ ID NO: 5270 - DNA, 20 bp, Homo sapiens
gcctgtctacacttgctgtg

SEQ ID NO: 5271 - DNA, 18 bp, Homo sapiens
tggcagtgtcttagctgg

SEQ ID NO: 5272 - DNA, 21 bp, Homo sapiens
gtgggcgggggcaggtgtgtg

SEQ ID NO: 5273 - DNA, 23 bp, Homo sapiens
ctcactcctctcctcccgtcttc

SEQ ID NO: 5274 - DNA, 19 bp, Homo sapiens
gggaccggccgcgactgcg

SEQ ID NO: 5275 - DNA, 22 bp, Homo sapiens
tggactgagccgtgctactggc

SEQ ID NO: 5276 - DNA, 21 bp, Homo sapiens
ctaatactgtctggtaaaacc

SEQ ID NO: 5277 - DNA, 21 bp, Homo sapiens
tgtgttgcatgtgtgtatatg

SEQ ID NO: 5278 - DNA, 20 bp, Homo sapiens
tcctgccctccttgctgtag

SEQ ID NO: 5279 - DNA, 21 bp, Homo sapiens
ggaatgtaaagaagtatgtat

SEQ ID NO: 5280 - DNA, 29 bp, Homo sapiens
tctcatggcaacaccagtcgatgggctgt

SEQ ID NO: 5281 - DNA, 25 bp, Homo sapiens
ccatctggaggtaagaagcactttg

SEQ ID NO: 5282 - DNA, 21 bp, Homo sapiens
gcaagatgctggcatagctgt

SEQ ID NO: 5283 - DNA, 20 bp, Homo sapiens
agtgcctgagggagtaagag

SEQ ID NO: 5284 - DNA, 20 bp, Homo sapiens
aggtagtttcctgttgttgg

SEQ ID NO: 5285 - DNA, 20 bp, Homo sapiens
ctaatactgccgggtaatga

SEQ ID NO: 5286 - DNA, 23 bp, Homo sapiens
ttatcagactgatgttgactgtt

SEQ ID NO: 5287 - DNA, 20 bp, Homo sapiens
catcgggaatgtcgtgtccg

SEQ ID NO: 5288 - DNA, 19 bp, Homo sapiens
acactgtctggtaacgatg

SEQ ID NO: 5289 - DNA, 20 bp, Homo sapiens
ctgtaacagcaactccatgt

SEQ ID NO: 5290 - DNA, 20 bp, Homo sapiens
ctccagccccacagcctcag

SEQ ID NO: 5291 - DNA, 18 bp, Homo sapiens
tcttggagtaggtcattg

SEQ ID NO: 5292 - DNA, 23 bp, Homo sapiens
aaaagctgggttgagagggcaaa

SEQ ID NO: 5293 - DNA, 21 bp, Homo sapiens
agaggataccctttgtatgtt

SEQ ID NO: 5294 - DNA, 20 bp, Homo sapiens
gtagattctccttctatgag

SEQ ID NO: 5295 - DNA, 22 bp, Homo sapiens
gagggttgggtggaggctctcc

SEQ ID NO: 5296 - DNA, 24 bp, Homo sapiens
ctgaagtgatgtgtaactgatcag

SEQ ID NO: 5297 - DNA, 23 bp, Homo sapiens
cactagattgtgagctcctggag

SEQ ID NO: 5298 - DNA, 19 bp, Homo sapiens
ttctcgaggaaagaagcac

SEQ ID NO: 5299 - DNA, 21 bp, Homo sapiens
tgtcactcggctcggcccact

SEQ ID NO: 5300 - DNA, 21 bp, Homo sapiens
gtcattggagggtttgagcag

SEQ ID NO: 5301 - DNA, 23 bp, Homo sapiens
ctgtcgattggacccgccctccg

SEQ ID NO: 5302 - DNA, 21 bp, Homo sapiens
aaagatctggaagtgggagac

SEQ ID NO: 5303 - DNA, 22 bp, Homo sapiens
accttcttgtataagcactgtg

SEQ ID NO: 5304 - DNA, 24 bp, Homo sapiens
tgcagctgcctgggagtgacttca

SEQ ID NO: 5305 - DNA, 19 bp, Homo sapiens
tcaaaactgaggggcattt

SEQ ID NO: 5306 - DNA, 18 bp, Homo sapiens
gtgtgggggagaggctgt

SEQ ID NO: 5307 - DNA, 21 bp, Homo sapiens
gtcccccaggtgtgattctga

SEQ ID NO: 5308 - DNA, 17 bp, Homo sapiens
gagaccctaacttgtga

SEQ ID NO: 5309 - DNA, 20 bp, Homo sapiens
ctacaaagggaagcactttc

SEQ ID NO: 5310 - DNA, 23 bp, Homo sapiens
gtaaacatccccgactggaagct

SEQ ID NO: 5311 - DNA, 18 bp, Homo sapiens
tcacagtgaaccggtctc

SEQ ID NO: 5312 - DNA, 21 bp, Homo sapiens
cagtctcatctgcaaagaagt

SEQ ID NO: 5313 - DNA, 20 bp, Homo sapiens
aatgtgtagcaaaagacaga

SEQ ID NO: 5314 - DNA, 22 bp, Homo sapiens
gctgaagctcagagggctctga

SEQ ID NO: 5315 - DNA, 26 bp, Homo sapiens
gccatagcccggtcgctggtacatga

SEQ ID NO: 5316 - DNA, 21 bp, Homo sapiens
ctgataagaacagaggcccag

SEQ ID NO: 5317 - DNA, 18 bp, Homo sapiens
tagtaggttgtgtggttt

SEQ ID NO: 5318 - DNA, 18 bp, Homo sapiens
cagagttgtcatgtgtct

SEQ ID NO: 5319 - DNA, 22 bp, Homo sapiens
tcagtatgccatgttgccatat

SEQ ID NO: 5320 - DNA, 20 bp, Homo sapiens
agggcttagctgcttgtgag

SEQ ID NO: 5321 - DNA, 20 bp, Homo sapiens
ctcaggtgctctggctgctt

SEQ ID NO: 5322 - DNA, 18 bp, Homo sapiens
ctgagatgaagcactgta

SEQ ID NO: 5323 - DNA, 20 bp, Homo sapiens
aaacgccattatcacactaa

SEQ ID NO: 5324 - DNA, 21 bp, Homo sapiens
gtagataaaatattggtacct

SEQ ID NO: 5325 - DNA, 20 bp, Homo sapiens
cagtccatgggcatatacac

SEQ ID NO: 5326 - DNA, 22 bp, Homo sapiens
tagccttcagatcttggtgttt

SEQ ID NO: 5327 - DNA, 24 bp, Homo sapiens
tgtgcaaatccatgcaaaactgat

SEQ ID NO: 5328 - DNA, 23 bp, Homo sapiens
taaatttcacctttctgagaagg

SEQ ID NO: 5329 - DNA, 21 bp, Homo sapiens
agtggttcttaacagttcaac

SEQ ID NO: 5330 - DNA, 21 bp, Homo sapiens
tcagtgcactacagaactttg

SEQ ID NO: 5331 - DNA, 19 bp, Homo sapiens
aactggccctcaaagtccc

SEQ ID NO: 5332 - DNA, 17 bp, Homo sapiens
cgtagatccgatcttgt

SEQ ID NO: 5333 - DNA, 18 bp, Homo sapiens
ccgtagatccgatcttgt

SEQ ID NO: 5334 - DNA, 22 bp, Homo sapiens
atggccaaaactgcagttattt

SEQ ID NO: 5335 - DNA, 21 bp, Homo sapiens
atggccaaaactgcagttatt

SEQ ID NO: 5336 - DNA, 21 bp, Homo sapiens
acgttggctctggtggtgatg

SEQ ID NO: 5337 - DNA, 19 bp, Homo sapiens
ggagaaaggacccttccag

SEQ ID NO: 5338 - DNA, 21 bp, Homo sapiens
tgttcctctgtctcccagact

SEQ ID NO: 5339 - DNA, 22 bp, Homo sapiens
atgcaccatggttgtctgagca

SEQ ID NO: 5340 - DNA, 20 bp, Homo sapiens
caaattcgtatctaggggaa

SEQ ID NO: 5341 - DNA, 21 bp, Homo sapiens
ctagactgaagctccttgagg

SEQ ID NO: 5342 - DNA, 18 bp, Homo sapiens
agtgctgacagtgcagat

SEQ ID NO: 5343 - DNA, 19 bp, Homo sapiens
gcgttcgtgcgacgtgtgg

SEQ ID NO: 5344 - DNA, 21 bp, Homo sapiens
gtgtgtgactggttgaccaga

SEQ ID NO: 5345 - DNA, 19 bp, Homo sapiens
actccatttgttttgatga

SEQ ID NO: 5346 - DNA, 21 bp, Homo sapiens
atatacagggggagactctta

SEQ ID NO: 5347 - DNA, 23 bp, Homo sapiens
ataatacatggttaacctctttt

SEQ ID NO: 5348 - DNA, 20 bp, Homo sapiens
ggcgttcgtgcgacgtgtgg

SEQ ID NO: 5349 - DNA, 19 bp, Homo sapiens
ctaatactgccgggtaatg

SEQ ID NO: 5350 - DNA, 21 bp, Homo sapiens
accgatttctcctggtgttca

SEQ ID NO: 5351 - DNA, 24 bp, Homo sapiens
cagcactagattgtaaagactggg

SEQ ID NO: 5352 - DNA, 21 bp, Homo sapiens
agctgccagttgaagaactgt

SEQ ID NO: 5353 - DNA, 24 bp, Homo sapiens
agaggtagtaggttgcatagtttt

SEQ ID NO: 5354 - DNA, 21 bp, Homo sapiens
aaatggtgccctagtgactac

SEQ ID NO: 5355 - DNA, 21 bp, Homo sapiens
aagcattctttcattggttgg

SEQ ID NO: 5356 - DNA, 19 bp, Homo sapiens
tttccggctcgcgtgggtg

SEQ ID NO: 5357 - DNA, 20 bp, Homo sapiens
aggcggagacttgggcaatt

SEQ ID NO: 5358 - DNA, 19 bp, Homo sapiens
ctggtacaggcctggggga

SEQ ID NO: 5359 - DNA, 22 bp, Homo sapiens
ccatcttccagtacagtgttgg

SEQ ID NO: 5360 - DNA, 18 bp, Homo sapiens
agaggtatagggcatggg

SEQ ID NO: 5361 - DNA, 21 bp, Homo sapiens
gacacgatcactcccgttgag

SEQ ID NO: 5362 - DNA, 19 bp, Homo sapiens
ctacattgtctgctgggtt

SEQ ID NO: 5363 - DNA, 20 bp, Homo sapiens
aagtgccgccatcttttgag

SEQ ID NO: 5364 - DNA, 18 bp, Homo sapiens
tgaggtagtagtttgtgc

SEQ ID NO: 5365 - DNA, 22 bp, Homo sapiens
ttccagtacagtgttggatggt

SEQ ID NO: 5366 - DNA, 18 bp, Homo sapiens
gacctatgaattgacaga

SEQ ID NO: 5367 - DNA, 18 bp, Homo sapiens
ctctggagggaagcactt

SEQ ID NO: 5368 - DNA, 24 bp, Homo sapiens
tagcaccatttgaaatcagtgttt

SEQ ID NO: 5369 - DNA, 21 bp, Homo sapiens
aaagtgcatccttttagaggt

SEQ ID NO: 5370 - DNA, 18 bp, Homo sapiens
acccgtagatccgaactt

SEQ ID NO: 5371 - DNA, 21 bp, Homo sapiens
gtgtggcgtgggtcgacctcc

SEQ ID NO: 5372 - DNA, 23 bp, Homo sapiens
atggcagccaggacaggactctc

SEQ ID NO: 5373 - DNA, 22 bp, Homo sapiens
gcgacgtgtggcgtgggtcgac

SEQ ID NO: 5374 - DNA, 21 bp, Homo sapiens
gcggcggtggtggggggagcc

SEQ ID NO: 5375 - DNA, 23 bp, Homo sapiens
tcatttatccccagcctacaaaa

SEQ ID NO: 5376 - DNA, 23 bp, Homo sapiens
gacgtgtggcgtgggtcgacctc

SEQ ID NO: 5377 - DNA, 23 bp, Homo sapiens
tttcagtggagtgaagttcagga

SEQ ID NO: 5378 - DNA, 22 bp, Homo sapiens
tttcagtggagtgaagttcagg

SEQ ID NO: 5379 - DNA, 21 bp, Homo sapiens
tttcagtggagtgaagttcag

SEQ ID NO: 5380 - DNA, 24 bp, Homo sapiens
tttcagtggagtgaagttcaggag

SEQ ID NO: 5381 - DNA, 20 bp, Homo sapiens
tttcagtggagtgaagttca

SEQ ID NO: 5382 - DNA, 21 bp, Homo sapiens
tgtccttcattccaccggagt

SEQ ID NO: 5383 - DNA, 22 bp, Homo sapiens
tgtccttcattccaccggagtc

SEQ ID NO: 5384 - DNA, 23 bp, Homo sapiens
tgtccttcattccaccggagtct

SEQ ID NO: 5385 - DNA, 20 bp, Homo sapiens
tgtccttcattccaccggag

SEQ ID NO: 5386 - DNA, 19 bp, Homo sapiens
tttcagtggagtgaagttc

SEQ ID NO: 5387 - DNA, 22 bp, Homo sapiens
atttcagtggagtgaagttcag

SEQ ID NO: 5388 - DNA, 19 bp, Homo sapiens
aacattcaacctgtcggtg

SEQ ID NO: 5389 - DNA, 18 bp, Homo sapiens
cgttcgtgcgacgtgtgg

SEQ ID NO: 5390 - DNA, 22 bp, Homo sapiens
attaggccgcagatctgggtga

SEQ ID NO: 5391 - DNA, 15 bp, Homo sapiens
taatactgccgggta

SEQ ID NO: 5392 - DNA, 21 bp, Homo sapiens
tgatatgtttgatattgggtt

SEQ ID NO: 5393 - DNA, 21 bp, Homo sapiens
aactgtttgcagaggaaactg

SEQ ID NO: 5394 - DNA, 19 bp, Homo sapiens
acattcattgctgtcggtg

SEQ ID NO: 5395 - DNA, 25 bp, Homo sapiens
aactggccctcaaagtcccgctttt

SEQ ID NO: 5396 - DNA, 21 bp, Homo sapiens
atgaggtagtaggttgtatag

SEQ ID NO: 5397 - DNA, 30 bp, Homo sapiens
gcaaagtgatgagtaatactggctggagcc

SEQ ID NO: 5398 - DNA, 19 bp, Homo sapiens
aacgcgcttccctatagag

SEQ ID NO: 5399 - DNA, 19 bp, Homo sapiens
ctttgctcagccagtgtag

SEQ ID NO: 5400 - DNA, 20 bp, Homo sapiens
tcagtttgtcaaatacccca

SEQ ID NO: 5401 - DNA, 23 bp, Homo sapiens
atgcacctgggcaaggattcaga

SEQ ID NO: 5402 - DNA, 17 bp, Homo sapiens
tgtaaacatccccgact

SEQ ID NO: 5403 - DNA, 22 bp, Homo sapiens
cacaaatctccggaccacttag

SEQ ID NO: 5404 - DNA, 22 bp, Homo sapiens
agtcattggagggtttgagcag

SEQ ID NO: 5405 - DNA, 19 bp, Homo sapiens
gctttttattcctatgtga

SEQ ID NO: 5406 - DNA, 19 bp, Homo sapiens
aatatgtcatgctgtggcc

SEQ ID NO: 5407 - DNA, 23 bp, Homo sapiens
agcccctgcccaccgcacactgc

SEQ ID NO: 5408 - DNA, 22 bp, Homo sapiens
tagaggagatggcgcaggggac

SEQ ID NO: 5409 - DNA, 23 bp, Homo sapiens
tagaggagatggcgcaggggaca

SEQ ID NO: 5410 - DNA, 22 bp, Homo sapiens
cacatggccgaaacagagaagt

SEQ ID NO: 5411 - DNA, 20 bp, Homo sapiens
gtgccgccatcttttgagtg

SEQ ID NO: 5412 - DNA, 21 bp, Homo sapiens
agatcagaaggtgattgtggc

SEQ ID NO: 5413 - DNA, 19 bp, Homo sapiens
cgttaccattactgagttt

SEQ ID NO: 5414 - DNA, 22 bp, Homo sapiens
tactcagaaaggtgccagtcac

SEQ ID NO: 5415 - DNA, 16 bp, Homo sapiens
cactacagaactttgt

SEQ ID NO: 5416 - DNA, 21 bp, Homo sapiens
gcagcacgtaaatattggcgt

SEQ ID NO: 5417 - DNA, 21 bp, Homo sapiens
aacgcgcttccctatagaggg

SEQ ID NO: 5418 - DNA, 20 bp, Homo sapiens
acgccattatcacactaaat

SEQ ID NO: 5419 - DNA, 20 bp, Homo sapiens
aaaagtgcttacagtgcagg

SEQ ID NO: 5420 - DNA, 22 bp, Homo sapiens
tagcagcacgtaaatattggcg

SEQ ID NO: 5421 - DNA, 22 bp, Homo sapiens
tggcaacaccagtcgatgggct

SEQ ID NO: 5422 - DNA, 22 bp, Homo sapiens
ctgaggagatcgtcgaggttgg

SEQ ID NO: 5423 - DNA, 22 bp, Homo sapiens
gaggagatcgtcgaggttggcc

SEQ ID NO: 5424 - DNA, 22 bp, Homo sapiens
cagaaggggagttgggagcaga

SEQ ID NO: 5425 - DNA, 25 bp, Homo sapiens
catgccttgagtgtaggaccgttgg

SEQ ID NO: 5426 - DNA, 26 bp, Homo sapiens
catgccttgagtgtaggaccgttggc

SEQ ID NO: 5427 - DNA, 24 bp, Homo sapiens
gggacgcgggcctggacgccggca

SEQ ID NO: 5428 - DNA, 23 bp, Homo sapiens
agctcatccatagttgtcactgt

SEQ ID NO: 5429 - DNA, 18 bp, Homo sapiens
tgaagcactgtagctcag

SEQ ID NO: 5430 - DNA, 23 bp, Homo sapiens
gcaccatggttgtctgagcatgc

SEQ ID NO: 5431 - DNA, 21 bp, Homo sapiens
atcaaggatcttaaactttgc

SEQ ID NO: 5432 - DNA, 20 bp, Homo sapiens
gaattgtggctggacatctg

SEQ ID NO: 5433 - DNA, 22 bp, Homo sapiens
gcagtgcaatgttaaaagggca

SEQ ID NO: 5434 - DNA, 17 bp, Homo sapiens
attccaccggagtctgt

SEQ ID NO: 5435 - DNA, 22 bp, Homo sapiens
cagggtagaaccacggacagga

SEQ ID NO: 5436 - DNA, 22 bp, Homo sapiens
tggtagaattcactgtgaacag

SEQ ID NO: 5437 - DNA, 24 bp, Homo sapiens
tggcactggtagaattcactgtga

SEQ ID NO: 5438 - DNA, 21 bp, Homo sapiens
atcgtgcggtacttgaagaaa

SEQ ID NO: 5439 - DNA, 16 bp, Homo sapiens
tttccggctcgcgtgg

SEQ ID NO: 5440 - DNA, 19 bp, Homo sapiens
gcaagatgctggcatagct

SEQ ID NO: 5441 - DNA, 19 bp, Homo sapiens
accatttgaaatcagtgtt

SEQ ID NO: 5442 - DNA, 19 bp, Homo sapiens
gctagataaccgaaagtaa

SEQ ID NO: 5443 - DNA, 19 bp, Homo sapiens
aagctagataaccgaaagt

SEQ ID NO: 5444 - DNA, 21 bp, Homo sapiens
ccagttttcccaggaatccct

SEQ ID NO: 5445 - DNA, 22 bp, Homo sapiens
cggacaggcgttcgtgcgacgt

SEQ ID NO: 5446 - DNA, 19 bp, Homo sapiens
gaattctccttttgggctt

SEQ ID NO: 5447 - DNA, 16 bp, Homo sapiens
tagatccgaacttgtg

SEQ ID NO: 5448 - DNA, 18 bp, Homo sapiens
ctgagaccctaacttgtg

SEQ ID NO: 5449 - DNA, 17 bp, Homo sapiens
ctagataaccgaaagta

SEQ ID NO: 5450 - DNA, 18 bp, Homo sapiens
ctagataaccgaaagtaa

SEQ ID NO: 5451 - DNA, 16 bp, Homo sapiens
gctagataaccgaaag

SEQ ID NO: 5452 - DNA, 17 bp, Homo sapiens
gtagtagattgtatagt

SEQ ID NO: 5453 - DNA, 20 bp, Homo sapiens
cctgagaccctaacttgtga

SEQ ID NO: 5454 - DNA, 17 bp, Homo sapiens
tagataaccgaaagtaa

SEQ ID NO: 5455 - DNA, 19 bp, Homo sapiens
ggtagtaggttgcatagtt

SEQ ID NO: 5456 - DNA, 16 bp, Homo sapiens
gtaggttgtatggttt

SEQ ID NO: 5457 - DNA, 16 bp, Homo sapiens
tagataaccgaaagta

SEQ ID NO: 5458 - DNA, 18 bp, Homo sapiens
tgagaccctaacttgtga

SEQ ID NO: 5459 - DNA, 17 bp, Homo sapiens
tggttatctagctgtat

SEQ ID NO: 5460 - DNA, 16 bp, Homo sapiens
ctagataaccgaaagt

SEQ ID NO: 5461 - DNA, 18 bp, Homo sapiens
ggtagtaggttgtatggt

SEQ ID NO: 5462 - DNA, 20 bp, Homo sapiens
ggtagtaggttgtatggttt

SEQ ID NO: 5463 - DNA, 15 bp, Homo sapiens
tagataaccgaaagt

SEQ ID NO: 5464 - DNA, 20 bp, Homo sapiens
ggtagtagattgtatagttt

SEQ ID NO: 5465 - DNA, 19 bp, Homo sapiens
aactggcctacaaagtccc

SEQ ID NO: 5466 - DNA, 20 bp, Homo sapiens
cccctgggcctatcctagaa

SEQ ID NO: 5467 - DNA, 21 bp, Homo sapiens
aatctctgcaggcaaatgtga

SEQ ID NO: 5468 - DNA, 20 bp, Homo sapiens
tatcatcatatactgtaagt

SEQ ID NO: 5469 - DNA, 18 bp, Homo sapiens
cccgtagatccgaacttg

SEQ ID NO: 5470 - DNA, 22 bp, Homo sapiens
atgtcactcggctcggcccact

SEQ ID NO: 5471 - DNA, 16 bp, Homo sapiens
tccctgagaccctaac

SEQ ID NO: 5472 - DNA, 25 bp, Homo sapiens
tccagcagggcacgcacagcgtccg

SEQ ID NO: 5473 - DNA, 21 bp, Homo sapiens
gtcagtgcactacagaacttt

SEQ ID NO: 5474 - DNA, 20 bp, Homo sapiens
aacacacctattcaaggatt

SEQ ID NO: 5475 - DNA, 20 bp, Homo sapiens
gctttcagtcggatgtttac

SEQ ID NO: 5476 - DNA, 21 bp, Homo sapiens
aaccatcgaccgttgagtgga

SEQ ID NO: 5477 - DNA, 20 bp, Homo sapiens
caagatgctggcatagctgt

SEQ ID NO: 5478 - DNA, 23 bp, Homo sapiens
tttcctcatattcattcaggagt

SEQ ID NO: 5479 - DNA, 20 bp, Homo sapiens
gcaccatttgaaatcggtta

SEQ ID NO: 5480 - DNA, 22 bp, Homo sapiens
aatcagcaagtatactgcccta

SEQ ID NO: 5481 - DNA, 24 bp, Homo sapiens
gtcagtgcactacagaactttgtc

SEQ ID NO: 5482 - DNA, 23 bp, Homo sapiens
ctaatactgcctggtaatgatga

SEQ ID NO: 5483 - DNA, 22 bp, Homo sapiens
ctaatactgcctggtaatgatg

SEQ ID NO: 5484 - DNA, 20 bp, Homo sapiens
tgatatgtttgatatattag

SEQ ID NO: 5485 - DNA, 23 bp, Homo sapiens
tggggaacccttccatgaggagt

SEQ ID NO: 5486 - DNA, 20 bp, Homo sapiens
tgacgtgcggtacttaatga

SEQ ID NO: 5487 - DNA, 24 bp, Homo sapiens
caccatcgtgcggtacttgaagaa

SEQ ID NO: 5488 - DNA, 23 bp, Homo sapiens
aacacacctattcaaggattcaa

SEQ ID NO: 5489 - DNA, 24 bp, Homo sapiens
ggagtgtgacaatggtgtttgtgt

SEQ ID NO: 5490 - DNA, 19 bp, Homo sapiens
caaattcgtatctagggga

SEQ ID NO: 5491 - DNA, 16 bp, Homo sapiens
tgtaaacatccccgac

SEQ ID NO: 5492 - DNA, 18 bp, Homo sapiens
tcaaaactgaggggcatt

SEQ ID NO: 5493 - DNA, 20 bp, Homo sapiens
gcaaagcacacggcctgcag

SEQ ID NO: 5494 - DNA, 20 bp, Homo sapiens
aaagctagataaccgaaagt

SEQ ID NO: 5495 - DNA, 21 bp, Homo sapiens
ctgctgagctagcacttcccg

SEQ ID NO: 5496 - DNA, 22 bp, Homo sapiens
cggctaacatgcaactgctgtc

SEQ ID NO: 5497 - DNA, 17 bp, Homo sapiens
cattgtacagggctatg

SEQ ID NO: 5498 - DNA, 24 bp, Homo sapiens
aatgcacctgggcaaggattcaga

SEQ ID NO: 5499 - DNA, 23 bp, Homo sapiens
atccttggaacctaggtgtgagt

SEQ ID NO: 5500 - DNA, 18 bp, Homo sapiens
aagatctcaagctgtgag

SEQ ID NO: 5501 - DNA, 20 bp, Homo sapiens
agaagagctcaggctgtgac

SEQ ID NO: 5502 - DNA, 18 bp, Homo sapiens
ctccagagggaagtactt

SEQ ID NO: 5503 - DNA, 18 bp, Homo sapiens
aagatctcaggttgtgac

SEQ ID NO: 5504 - DNA, 18 bp, Homo sapiens
gaagatctcaggctgtgt

SEQ ID NO: 5505 - DNA, 19 bp, Homo sapiens
gaagatgtcaggctgtgac

SEQ ID NO: 5506 - DNA, 18 bp, Homo sapiens
gaagatctcaggcagtga

SEQ ID NO: 5507 - DNA, 19 bp, Homo sapiens
caagatctcaggctgtgac

SEQ ID NO: 5508 - DNA, 18 bp, Homo sapiens
atatgtcatgctgtggcc

SEQ ID NO: 5509 - DNA, 23 bp, Homo sapiens
ctgtgaaactgggctcaaggtga

SEQ ID NO: 5510 - DNA, 18 bp, Homo sapiens
tctcacacagaaatcgca

SEQ ID NO: 5511 - DNA, 20 bp, Homo sapiens
attcaacgctgtcggtgagt

SEQ ID NO: 5512 - DNA, 22 bp, Homo sapiens
aaactctacttgtccttctgag

SEQ ID NO: 5513 - DNA, 19 bp, Homo sapiens
tagtgtttcctactttatg

SEQ ID NO: 5514 - DNA, 17 bp, Homo sapiens
tctcacacagaaatcgc

SEQ ID NO: 5515 - DNA, 18 bp, Homo sapiens
tatgtgcctttggactac

SEQ ID NO: 5516 - DNA, 20 bp, Homo sapiens
caatattactgtgctgcttt

SEQ ID NO: 5517 - DNA, 20 bp, Homo sapiens
tggagagaaaggcagttcct

SEQ ID NO: 5518 - DNA, 20 bp, Homo sapiens
actgatttcttttggtgttc

SEQ ID NO: 5519 - DNA, 19 bp, Homo sapiens
aatgacacgatcactcccg

SEQ ID NO: 5520 - DNA, 18 bp, Homo sapiens
aatgacacgatcactccc

SEQ ID NO: 5521 - DNA, 20 bp, Homo sapiens
tatacaatctactgtctttc

SEQ ID NO: 5522 - DNA, 17 bp, Homo sapiens
ctagactgaagctcctt

SEQ ID NO: 5523 - DNA, 19 bp, Homo sapiens
atcgccgagggccggtcgg

SEQ ID NO: 5524 - DNA, 20 bp, Homo sapiens
tgtgaaatgtttaggaccac

SEQ ID NO: 5525 - DNA, 24 bp, Homo sapiens
gcgtccccttccccgccggccgcc

SEQ ID NO: 5526 - DNA, 15 bp, Homo sapiens
tagcagcacgtaaat

SEQ ID NO: 5527 - DNA, 19 bp, Homo sapiens
tgctatgccaacatattgc

SEQ ID NO: 5528 - DNA, 21 bp, Homo sapiens
actgtacagcctcctagcttt

SEQ ID NO: 5529 - DNA, 22 bp, Homo sapiens
ccctgagaccctaacttgtgat

SEQ ID NO: 5530 - DNA, 19 bp, Homo sapiens
tatggctttttattcctat

SEQ ID NO: 5531 - DNA, 19 bp, Homo sapiens
ccctgagaccctaacttgt

SEQ ID NO: 5532 - DNA, 20 bp, Homo sapiens
aaccatcgaccgttgagtgg

SEQ ID NO: 5533 - DNA, 21 bp, Homo sapiens
ctgagaactgaattccatagg

SEQ ID NO: 5534 - DNA, 21 bp, Homo sapiens
actgatttcttttggtgttca

SEQ ID NO: 5535 - DNA, 21 bp, Homo sapiens
tctacaaaggaaagcgctttc

SEQ ID NO: 5536 - DNA, 22 bp, Homo sapiens
aaagtgcttccctttggtgaat

SEQ ID NO: 5537 - DNA, 24 bp, Homo sapiens
ttattgcttaagaatacgcgtagt

SEQ ID NO: 5538 - DNA, 26 bp, Homo sapiens
cgaatgttgctcggtgaacccctttt

SEQ ID NO: 5539 - DNA, 18 bp, Homo sapiens
aactggccctcaaagtcc

SEQ ID NO: 5540 - DNA, 20 bp, Homo sapiens
aacggaatcccaaaagcagc

SEQ ID NO: 5541 - DNA, 26 bp, Homo sapiens
ttggcaatggtagaactcacactggt

SEQ ID NO: 5542 - DNA, 17 bp, Homo sapiens
cagggtagaaccacgga

SEQ ID NO: 5543 - DNA, 20 bp, Homo sapiens
gagaattgtggctggacatc

SEQ ID NO: 5544 - DNA, 21 bp, Homo sapiens
agccacaactaccctgccact

SEQ ID NO: 5545 - DNA, 21 bp, Homo sapiens
ccgggtgccgcgcggtgccgc

SEQ ID NO: 5546 - DNA, 25 bp, Homo sapiens
gtgcctactgagctgaaacacagtt

SEQ ID NO: 5547 - DNA, 20 bp, Homo sapiens
ggtcggccgccccgggtgcc

SEQ ID NO: 5548 - DNA, 24 bp, Homo sapiens
ggtcggccgcgctcgaggggtccc

SEQ ID NO: 5549 - DNA, 25 bp, Homo sapiens
ggtcggccgcgctcgaggggtcccc

SEQ ID NO: 5550 - DNA, 24 bp, Homo sapiens
gtcggccgcgctcgaggggtcccc

SEQ ID NO: 5551 - DNA, 19 bp, Homo sapiens
gcggggatcgccgagggcc

SEQ ID NO: 5552 - DNA, 24 bp, Homo sapiens
acccagtgtttagactatctgttc

SEQ ID NO: 5553 - DNA, 22 bp, Homo sapiens
aaacatggttccgtcaagcacc

SEQ ID NO: 5554 - DNA, 19 bp, Homo sapiens
ccgtagatccgatcttgtg

SEQ ID NO: 5555 - DNA, 20 bp, Homo sapiens
caagctcgcttctatgggtc

SEQ ID NO: 5556 - DNA, 19 bp, Homo sapiens
ctcaaacccctttctacac

SEQ ID NO: 5557 - DNA, 25 bp, Homo sapiens
tggcgtccccttccccgccggccgc

SEQ ID NO: 5558 - DNA, 24 bp, Homo sapiens
gtggcgtccccttccccgccggcc

SEQ ID NO: 5559 - DNA, 20 bp, Homo sapiens
gattcctggaaatactgttc

SEQ ID NO: 5560 - DNA, 23 bp, Homo sapiens
acatgcttctttatatccccata

SEQ ID NO: 5561 - DNA, 16 bp, Homo sapiens
ttatggtttgcctggg

SEQ ID NO: 5562 - DNA, 18 bp, Homo sapiens
tagactatggaacgtagg

SEQ ID NO: 5563 - DNA, 17 bp, Homo sapiens
gtgctgacagtgcagat

SEQ ID NO: 5564 - DNA, 21 bp, Homo sapiens
ttttcctatgcatatacttct

SEQ ID NO: 5565 - DNA, 24 bp, Homo sapiens
ggagcaagatctcaggctgtgacc

SEQ ID NO: 5566 - DNA, 21 bp, Homo sapiens
agaagatctcatgctgtgacc

SEQ ID NO: 5567 - DNA, 24 bp, Homo sapiens
gcaagaagatctcatgctgtgacc

SEQ ID NO: 5568 - DNA, 21 bp, Homo sapiens
aagaaggtctcgggctgtgac

SEQ ID NO: 5569 - DNA, 22 bp, Homo sapiens
aagaagatctcaagctgtgact

SEQ ID NO: 5570 - DNA, 22 bp, Homo sapiens
gtgacaactatggatgagctct

SEQ ID NO: 5571 - DNA, 22 bp, Homo sapiens
agctcatccatagttgtcactg

SEQ ID NO: 5572 - DNA, 17 bp, Homo sapiens
aacattcaacgctgtcg

SEQ ID NO: 5573 - DNA, 22 bp, Homo sapiens
ggctcagttcagcaggaacagg

SEQ ID NO: 5574 - DNA, 18 bp, Homo sapiens
cccgtagatccgatcttg

SEQ ID NO: 5575 - DNA, 20 bp, Homo sapiens
ggtacttctcagtctgtggc

SEQ ID NO: 5576 - DNA, 24 bp, Homo sapiens
gcaagaagatctcaagctgtgggt

SEQ ID NO: 5577 - DNA, 22 bp, Homo sapiens
aagaagatctcatgctgtgacc

SEQ ID NO: 5578 - DNA, 19 bp, Homo sapiens
agtgaagctcaggctgtga

SEQ ID NO: 5579 - DNA, 22 bp, Homo sapiens
aaagcacctccagagcttgaag

SEQ ID NO: 5580 - DNA, 23 bp, Homo sapiens
aaagcgcttcccttcagagtgtt

SEQ ID NO: 5581 - DNA, 19 bp, Homo sapiens
cctgttctccattacttgg

SEQ ID NO: 5582 - DNA, 17 bp, Homo sapiens
tcgaccggacctcgacc

SEQ ID NO: 5583 - DNA, 19 bp, Homo sapiens
agaagatctcaggcagtga

SEQ ID NO: 5584 - DNA, 18 bp, Homo sapiens
actgccgggtaatgatgg

SEQ ID NO: 5585 - DNA, 21 bp, Homo sapiens
ggctcagtagccagtgtagat

SEQ ID NO: 5586 - DNA, 21 bp, Homo sapiens
acggtgctggatgtggccttt

SEQ ID NO: 5587 - DNA, 20 bp, Homo sapiens
gctctgactttattgcacta

SEQ ID NO: 5588 - DNA, 21 bp, Homo sapiens
cccgtcccgttcgtccccgga

SEQ ID NO: 5589 - DNA, 21 bp, Homo sapiens
tatcatcatatactgtaagtt

SEQ ID NO: 5590 - DNA, 19 bp, Homo sapiens
agtgctgacagtgcagata

SEQ ID NO: 5591 - DNA, 23 bp, Homo sapiens
ggggtgctatctgtgattgaggg

SEQ ID NO: 5592 - DNA, 20 bp, Homo sapiens
ttgcactcgtcccggcctcc

SEQ ID NO: 5593 - DNA, 19 bp, Homo sapiens
taaggtgcatctagtgcag

SEQ ID NO: 5594 - DNA, 24 bp, Homo sapiens
tttgttcgttcggctcgcgtgagg

SEQ ID NO: 5595 - DNA, 20 bp, Homo sapiens
cctcagggctgtagaacagg

SEQ ID NO: 5596 - DNA, 19 bp, Homo sapiens
ttcattgctgtcggtgggt

SEQ ID NO: 5597 - DNA, 18 bp, Homo sapiens
atcgaccgttgattgtac

SEQ ID NO: 5598 - DNA, 19 bp, Homo sapiens
agcacgtaaatattggcgt

SEQ ID NO: 5599 - DNA, 17 bp, Homo sapiens
gtgtattgttagctggt

SEQ ID NO: 5600 - DNA, 19 bp, Homo sapiens
ctggccctcaaagtcccgc

SEQ ID NO: 5601 - DNA, 24 bp, Homo sapiens
ttgtgtcaatatgcgatgatgtgt

SEQ ID NO: 5602 - DNA, 23 bp, Homo sapiens
attgtgtcaatatgcgatgatgt

SEQ ID NO: 5603 - DNA, 22 bp, Homo sapiens
ggaagcccttaccccaaaaagt

SEQ ID NO: 5604 - DNA, 22 bp, Homo sapiens
caacaagtcacagccggcctca

SEQ ID NO: 5605 - DNA, 22 bp, Homo sapiens
tttcctcatattcattcaggag

SEQ ID NO: 5606 - DNA, 19 bp, Homo sapiens
ggatatcatcatatactgt

SEQ ID NO: 5607 - DNA, 17 bp, Homo sapiens
tacagtatagatgatgt

SEQ ID NO: 5608 - DNA, 21 bp, Homo sapiens
aagtgcttcgattttggggtg

SEQ ID NO: 5609 - DNA, 22 bp, Homo sapiens
ccaaagcgcttccctttggagc

SEQ ID NO: 5610 - DNA, 16 bp, Homo sapiens
cacgtaaatattggcg

SEQ ID NO: 5611 - DNA, 20 bp, Homo sapiens
taagatggttgggtttggat

SEQ ID NO: 5612 - DNA, 20 bp, Homo sapiens
gctgggttgagagggcgaaa

SEQ ID NO: 5613 - DNA, 23 bp, Homo sapiens
atcctcgactggaagctgtgaag

SEQ ID NO: 5614 - DNA, 22 bp, Homo sapiens
tagcccggtcgctggtacatga

SEQ ID NO: 5615 - DNA, 19 bp, Homo sapiens
tgacacgatcactcccgtt

SEQ ID NO: 5616 - DNA, 22 bp, Homo sapiens
gctggtcaaacggaaccaagtc

SEQ ID NO: 5617 - DNA, 22 bp, Homo sapiens
tgacctatgaattgacagacaa

SEQ ID NO: 5618 - DNA, 25 bp, Homo sapiens
tcatggcaacaccagtcgatgggct

SEQ ID NO: 5619 - DNA, 22 bp, Homo sapiens
ctcagggctgtagaacagggct

SEQ ID NO: 5620 - DNA, 22 bp, Homo sapiens
ccaagtcaggtactcgaatgga

SEQ ID NO: 5621 - DNA, 21 bp, Homo sapiens
aaagtgctgtcatagctgagg

SEQ ID NO: 5622 - DNA, 18 bp, Homo sapiens
agatctcaggctgtgtcc

SEQ ID NO: 5623 - DNA, 20 bp, Homo sapiens
aagaagatctcaggcagtga

SEQ ID NO: 5624 - DNA, 22 bp, Homo sapiens
ctcacagtgaaccggtctcttt

SEQ ID NO: 5625 - DNA, 19 bp, Homo sapiens
cggggttttgagggcgaga

SEQ ID NO: 5626 - DNA, 22 bp, Homo sapiens
acaaaaaaaaaagcccaaccct

SEQ ID NO: 5627 - DNA, 20 bp, Homo sapiens
accgatttctcctggtgttc

SEQ ID NO: 5628 - DNA, 22 bp, Homo sapiens
atattgcactcgtcccggcctc

SEQ ID NO: 5629 - DNA, 18 bp, Homo sapiens
gaactgaattccatgggt

SEQ ID NO: 5630 - DNA, 21 bp, Homo sapiens
tgcagctgcctgggagtgact

SEQ ID NO: 5631 - DNA, 18 bp, Homo sapiens
gacctatgaattgacagc

SEQ ID NO: 5632 - DNA, 17 bp, Homo sapiens
tcctgtactgagctgcc

SEQ ID NO: 5633 - DNA, 18 bp, Homo sapiens
atcatcatatactgtaag

SEQ ID NO: 5634 - DNA, 20 bp, Homo sapiens
tcaagagcaataacgaaaaa

SEQ ID NO: 5635 - DNA, 21 bp, Homo sapiens
ccaaagcgcttccctttggag

SEQ ID NO: 5636 - DNA, 23 bp, Homo sapiens
gcaagaagatctcaggctgtgtc

SEQ ID NO: 5637 - DNA, 24 bp, Homo sapiens
atgacctatgaattgacagacaat

SEQ ID NO: 5638 - DNA, 19 bp, Homo sapiens
aagtgctgcgacatttgag

SEQ ID NO: 5639 - DNA, 18 bp, Homo sapiens
aaagtgctgcgacatttg

SEQ ID NO: 5640 - DNA, 20 bp, Homo sapiens
agtgctgcgacatttgagcg

SEQ ID NO: 5641 - DNA, 19 bp, Homo sapiens
aggatctcaggctgtgacc

SEQ ID NO: 5642 - DNA, 23 bp, Homo sapiens
ggagtgtgacaatggtgtttgtg

SEQ ID NO: 5643 - DNA, 21 bp, Homo sapiens
ttgctgttgacagtgagcgac

SEQ ID NO: 5644 - DNA, 19 bp, Homo sapiens
aattgcacggtatccatct

SEQ ID NO: 5645 - DNA, 17 bp, Homo sapiens
tgcaccatggttgtctg

SEQ ID NO: 5646 - DNA, 16 bp, Homo sapiens
tagcaccatctgaaat

SEQ ID NO: 5647 - DNA, 16 bp, Homo sapiens
catgccttgagtgtag

SEQ ID NO: 5648 - DNA, 19 bp, Homo sapiens
attgcacttgtcccggcct

SEQ ID NO: 5649 - DNA, 23 bp, Homo sapiens
ggcaacaccagtcgatgggctgt

SEQ ID NO: 5650 - DNA, 22 bp, Homo sapiens
gcccctggggctggcttggcag

SEQ ID NO: 5651 - DNA, 21 bp, Homo sapiens
tgatgatacaggtggaggtag

SEQ ID NO: 5652 - DNA, 23 bp, Homo sapiens
aagttgcccgtgtttttttcgct

SEQ ID NO: 5653 - DNA, 23 bp, Homo sapiens
tgcctactgagctgaaacacagt

SEQ ID NO: 5654 - DNA, 24 bp, Homo sapiens
ctctgattgaaacatgcagcagct

SEQ ID NO: 5655 - DNA, 23 bp, Homo sapiens
tggcgtccccttccccgccggcc

SEQ ID NO: 5656 - DNA, 24 bp, Homo sapiens
ccgtggcgtccccttccccgccgg

SEQ ID NO: 5657 - DNA, 24 bp, Homo sapiens
aggcagtgtattgttagctggctg

SEQ ID NO: 5658 - DNA, 30 bp, Homo sapiens
ttaaaatcaaaaccatcgaccgttgattgt

SEQ ID NO: 5659 - DNA, 29 bp, Homo sapiens
tgtggacaagctcactgaacaatgaatgc

SEQ ID NO: 5660 - DNA, 21 bp, Homo sapiens
gctcttttcacattgtgctac

SEQ ID NO: 5661 - DNA, 21 bp, Homo sapiens
cccagataatggcactctcaa

SEQ ID NO: 5662 - DNA, 21 bp, Homo sapiens
aagtgctcatagtgcaggtag

SEQ ID NO: 5663 - DNA, 23 bp, Homo sapiens
tctgggtggtctggagatttgtg

SEQ ID NO: 5664 - DNA, 18 bp, Homo sapiens
gctacattgtctgctggg

SEQ ID NO: 5665 - DNA, 21 bp, Homo sapiens
caaaagtgatcgtggtttttg

SEQ ID NO: 5666 - DNA, 19 bp, Homo sapiens
acccgtagatccgatcttg

SEQ ID NO: 5667 - DNA, 21 bp, Homo sapiens
tgaggtagtagattgtatagt

SEQ ID NO: 5668 - DNA, 18 bp, Homo sapiens
ggtagtagtttgtacagt

SEQ ID NO: 5669 - DNA, 23 bp, Homo sapiens
tcggctaacatgcaactgctgtc

SEQ ID NO: 5670 - DNA, 22 bp, Homo sapiens
aggtagtttcatgttgttgggc

SEQ ID NO: 5671 - DNA, 20 bp, Homo sapiens
catcgaccgttgattgtacc

SEQ ID NO: 5672 - DNA, 21 bp, Homo sapiens
agcccctgcccaccgcacact

SEQ ID NO: 5673 - DNA, 18 bp, Homo sapiens
acattcaacgctgtcggt

SEQ ID NO: 5674 - DNA, 18 bp, Homo sapiens
caacgctgtcggtgagtt

SEQ ID NO: 5675 - DNA, 17 bp, Homo sapiens
ttcaacgctgtcggtga

SEQ ID NO: 5676 - DNA, 17 bp, Homo sapiens
acattcaacgctgtcgg

SEQ ID NO: 5677 - DNA, 19 bp, Homo sapiens
caacgctgtcggtgagttt

SEQ ID NO: 5678 - DNA, 16 bp, Homo sapiens
caacgctgtcggtgag

SEQ ID NO: 5679 - DNA, 20 bp, Homo sapiens
ttcattgctgtcggtgggtt

SEQ ID NO: 5680 - DNA, 18 bp, Homo sapiens
tgagaactgaattccatg

SEQ ID NO: 5681 - DNA, 16 bp, Homo sapiens
tcaacgctgtcggtga

SEQ ID NO: 5682 - DNA, 18 bp, Homo sapiens
tcaacgctgtcggtgagt

SEQ ID NO: 5683 - DNA, 19 bp, Homo sapiens
attcaacgctgtcggtgag

SEQ ID NO: 5684 - DNA, 19 bp, Homo sapiens
ccatcgaccgttgattgta

SEQ ID NO: 5685 - DNA, 18 bp, Homo sapiens
ccatcgaccgttgattgt

SEQ ID NO: 5686 - DNA, 18 bp, Homo sapiens
ctcactgaacaatgaatg

SEQ ID NO: 5687 - DNA, 16 bp, Homo sapiens
gaccgttgattgtacc

SEQ ID NO: 5688 - DNA, 19 bp, Homo sapiens
gcagcacatcatggtttac

SEQ ID NO: 5689 - DNA, 18 bp, Homo sapiens
cattcaacgctgtcggtg

SEQ ID NO: 5690 - DNA, 22 bp, Homo sapiens
tgggatctccggggtcttggtt

SEQ ID NO: 5691 - DNA, 19 bp, Homo sapiens
aactgaattccataggctg

SEQ ID NO: 5692 - DNA, 20 bp, Homo sapiens
caaatctccggaccacttag

SEQ ID NO: 5693 - DNA, 21 bp, Homo sapiens
tgggatctccggggtcttggt

SEQ ID NO: 5694 - DNA, 20 bp, Homo sapiens
ctgggatctccggggtcttg

SEQ ID NO: 5695 - DNA, 22 bp, Homo sapiens
ctgggatctccggggtcttggt

SEQ ID NO: 5696 - DNA, 20 bp, Homo sapiens
gctgattcctgggctctgac

SEQ ID NO: 5697 - DNA, 21 bp, Homo sapiens
tgctgattcctgggctctgac

SEQ ID NO: 5698 - DNA, 20 bp, Homo sapiens
gggccccccctcaatcctgt

SEQ ID NO: 5699 - DNA, 19 bp, Homo sapiens
tgattcctgggctctgacc

SEQ ID NO: 5700 - DNA, 21 bp, Homo sapiens
cacctgacctcccatgcctgt

SEQ ID NO: 5701 - DNA, 22 bp, Homo sapiens
tgaggtagtagtttgtacagtt

SEQ ID NO: 5702 - DNA, 19 bp, Homo sapiens
caaagtgcctccctttaga

SEQ ID NO: 5703 - DNA, 21 bp, Homo sapiens
aacccgtagatccgaacttgt

SEQ ID NO: 5704 - DNA, 20 bp, Homo sapiens
tctgtcatttctttaggcca

SEQ ID NO: 5705 - DNA, 22 bp, Homo sapiens
taaaaactgcaattactttcac

SEQ ID NO: 5706 - DNA, 23 bp, Homo sapiens
cacaaatctccggaccacttagt

SEQ ID NO: 5707 - DNA, 20 bp, Homo sapiens
cctgtactgagctgccccga

SEQ ID NO: 5708 - DNA, 21 bp, Homo sapiens
aaagtgctgttcgtgcaggta

SEQ ID NO: 5709 - DNA, 19 bp, Homo sapiens
ttgcagctgcctgggagtg

SEQ ID NO: 5710 - DNA, 22 bp, Homo sapiens
caaagcgcttccctttggagcg

SEQ ID NO: 5711 - DNA, 17 bp, Homo sapiens
agtgctgttcgtgcagg

SEQ ID NO: 5712 - DNA, 23 bp, Homo sapiens
agcctctaagaagttgactgaag

SEQ ID NO: 5713 - DNA, 22 bp, Homo sapiens
ttgagaatgatgaatcattagg

SEQ ID NO: 5714 - DNA, 24 bp, Homo sapiens
ggggtgctatctgtgattgaggga

SEQ ID NO: 5715 - DNA, 21 bp, Homo sapiens
aggtagtttcctgttgttggg

SEQ ID NO: 5716 - DNA, 19 bp, Homo sapiens
caaagtgctcatagtgcag

SEQ ID NO: 5717 - DNA, 20 bp, Homo sapiens
tctgctcataccccatggtt

SEQ ID NO: 5718 - DNA, 20 bp, Homo sapiens
attgcactcgtcccggcctc

SEQ ID NO: 5719 - DNA, 19 bp, Homo sapiens
aaagtgctgcgacatttga

SEQ ID NO: 5720 - DNA, 26 bp, Homo sapiens
tgcaccatggttgtctgagcatgcag

SEQ ID NO: 5721 - DNA, 21 bp, Homo sapiens
atttgtgcttggctctgtcac

SEQ ID NO: 5722 - DNA, 20 bp, Homo sapiens
gctggtttcatatggtggtt

SEQ ID NO: 5723 - DNA, 21 bp, Homo sapiens
tagtggatgatggagactcgg

SEQ ID NO: 5724 - DNA, 20 bp, Homo sapiens
caaagtgcttccctttagag

SEQ ID NO: 5725 - DNA, 21 bp, Homo sapiens
catcgtgcggtacttgaagaa

SEQ ID NO: 5726 - DNA, 23 bp, Homo sapiens
accatcgtgcggtacttgaagaa

SEQ ID NO: 5727 - DNA, 24 bp, Homo sapiens
aagtgccgccatcttttgagtgtt

SEQ ID NO: 5728 - DNA, 21 bp, Homo sapiens
acatgcttctttatatcccca

SEQ ID NO: 5729 - DNA, 19 bp, Homo sapiens
ctcaaactgtgggggcact

SEQ ID NO: 5730 - DNA, 20 bp, Homo sapiens
aaagtgcatccttttagagt

SEQ ID NO: 5731 - DNA, 19 bp, Homo sapiens
atctggaggtaagaagcac

SEQ ID NO: 5732 - DNA, 21 bp, Homo sapiens
atcgtgcatccttttagagtg

SEQ ID NO: 5733 - DNA, 18 bp, Homo sapiens
cagcaattcatgttttga

SEQ ID NO: 5734 - DNA, 18 bp, Homo sapiens
atgctcagactcctgtgg

SEQ ID NO: 5735 - DNA, 21 bp, Homo sapiens
caagagcaataacgaaaaatg

SEQ ID NO: 5736 - DNA, 21 bp, Homo sapiens
ctgcatcaggaactgattgga

SEQ ID NO: 5737 - DNA, 20 bp, Homo sapiens
cagttgttcaaccagttact

SEQ ID NO: 5738 - DNA, 19 bp, Homo sapiens
tggcagtgtattgttagct

SEQ ID NO: 5739 - DNA, 21 bp, Homo sapiens
atattgcactcgtcccggcct

SEQ ID NO: 5740 - DNA, 17 bp, Homo sapiens
gcaatggtagaactcac

SEQ ID NO: 5741 - DNA, 23 bp, Homo sapiens
tgtctactactggagacactggt

SEQ ID NO: 5742 - DNA, 20 bp, Homo sapiens
ttctctgttttggccatgtg

SEQ ID NO: 5743 - DNA, 22 bp, Homo sapiens
caaagaattctccttttgggct

SEQ ID NO: 5744 - DNA, 16 bp, Homo sapiens
attccaccggagtctg

SEQ ID NO: 5745 - DNA, 20 bp, Homo sapiens
atcgtgcatccttttagagt

SEQ ID NO: 5746 - DNA, 21 bp, Homo sapiens
caaagcgcttccctttggagc

SEQ ID NO: 5747 - DNA, 22 bp, Homo sapiens
agtgcaatagtattgtcaaagc

SEQ ID NO: 5748 - DNA, 19 bp, Homo sapiens
ctctagctgccaaaggcgc

SEQ ID NO: 5749 - DNA, 18 bp, Homo sapiens
tgtttcctactttatgga

SEQ ID NO: 5750 - DNA, 18 bp, Homo sapiens
ctgccctggcccgaggga

SEQ ID NO: 5751 - DNA, 21 bp, Homo sapiens
tggcttttcattcctatgtga

SEQ ID NO: 5752 - DNA, 20 bp, Homo sapiens
gttaccattactgagtttag

SEQ ID NO: 5753 - DNA, 19 bp, Homo sapiens
gcagcacataatggtttgt

SEQ ID NO: 5754 - DNA, 19 bp, Homo sapiens
tatacaatctactgtcttt

SEQ ID NO: 5755 - DNA, 20 bp, Homo sapiens
ggagcttacaatctagctgg

SEQ ID NO: 5756 - DNA, 20 bp, Homo sapiens
aagtgcttacagtgcaggta

SEQ ID NO: 5757 - DNA, 19 bp, Homo sapiens
cgcactgtgggtacttgct

SEQ ID NO: 5758 - DNA, 19 bp, Homo sapiens
aggtagtaggttgcatagt

SEQ ID NO: 5759 - DNA, 17 bp, Homo sapiens
acatccttgactggaag

SEQ ID NO: 5760 - DNA, 17 bp, Homo sapiens
cgttaccattactgagt

SEQ ID NO: 5761 - DNA, 16 bp, Homo sapiens
ttgttcgttcggctcg

SEQ ID NO: 5762 - DNA, 20 bp, Homo sapiens
cggggcagctcagtacagga

SEQ ID NO: 5763 - DNA, 19 bp, Homo sapiens
aaagcgcttcccttcagag

SEQ ID NO: 5764 - DNA, 18 bp, Homo sapiens
tcctgtactgagctgccc

SEQ ID NO: 5765 - DNA, 19 bp, Homo sapiens
ccaatattactgtgctgct

SEQ ID NO: 5766 - DNA, 20 bp, Homo sapiens
ccaatattactgtgctgctt

SEQ ID NO: 5767 - DNA, 19 bp, Homo sapiens
tgtgaggttggcattgttg

SEQ ID NO: 5768 - DNA, 15 bp, Homo sapiens
aaaccgttaccatta

SEQ ID NO: 5769 - DNA, 19 bp, Homo sapiens
tgtcttactccctcaggca

SEQ ID NO: 5770 - DNA, 21 bp, Homo sapiens
atcctgtactgagctgccccg

SEQ ID NO: 5771 - DNA, 19 bp, Homo sapiens
accgcactgtgggtacttg

SEQ ID NO: 5772 - DNA, 21 bp, Homo sapiens
gttaccattactgagtttagt

SEQ ID NO: 5773 - DNA, 19 bp, Homo sapiens
gttaccattactgagttta

SEQ ID NO: 5774 - DNA, 18 bp, Homo sapiens
tagcagcacataatggtt

SEQ ID NO: 5775 - DNA, 19 bp, Homo sapiens
tggagagaaaggcagttcc

SEQ ID NO: 5776 - DNA, 15 bp, Homo sapiens
gcacgtaaatattgg

SEQ ID NO: 5777 - DNA, 20 bp, Homo sapiens
atatcatcatatactgtaag

SEQ ID NO: 5778 - DNA, 21 bp, Homo sapiens
tcctgccctccttgctgtaga

SEQ ID NO: 5779 - DNA, 20 bp, Homo sapiens
tgtcttactccctcaggcac

SEQ ID NO: 5780 - DNA, 16 bp, Homo sapiens
caaagtgctgttcgtg

SEQ ID NO: 5781 - DNA, 16 bp, Homo sapiens
gtatagatgatgtact

SEQ ID NO: 5782 - DNA, 18 bp, Homo sapiens
taaagtgctgacagtgca

SEQ ID NO: 5783 - DNA, 17 bp, Homo sapiens
taaagtgctgacagtgc

SEQ ID NO: 5784 - DNA, 17 bp, Homo sapiens
aaaccgttaccattact

SEQ ID NO: 5785 - DNA, 16 bp, Homo sapiens
aaaccgttaccattac

SEQ ID NO: 5786 - DNA, 19 bp, Homo sapiens
accaatattactgtgctgc

SEQ ID NO: 5787 - DNA, 19 bp, Homo sapiens
ccacctcccctgcaaacgt

SEQ ID NO: 5788 - DNA, 15 bp, Homo sapiens
tgaggtagtagattg

SEQ ID NO: 5789 - DNA, 18 bp, Homo sapiens
tagcagcacgtaaatatt

SEQ ID NO: 5790 - DNA, 24 bp, Homo sapiens
ggatatcatcatatactgtaagtt

SEQ ID NO: 5791 - DNA, 18 bp, Homo sapiens
tcatcatatactgtaagt

SEQ ID NO: 5792 - DNA, 19 bp, Homo sapiens
tgtgcaaatccatgcaaaa

SEQ ID NO: 5793 - DNA, 20 bp, Homo sapiens
tagtaccagtaccttgtgtt

SEQ ID NO: 5794 - DNA, 17 bp, Homo sapiens
ctacagtatagatgatg

SEQ ID NO: 5795 - DNA, 18 bp, Homo sapiens
ctacagtatagatgatgt

SEQ ID NO: 5796 - DNA, 21 bp, Homo sapiens
ctgtactgagctgccccgagg

SEQ ID NO: 5797 - DNA, 23 bp, Homo sapiens
aaccgttaccattactgagttta

SEQ ID NO: 5798 - DNA, 25 bp, Homo sapiens
aaccgttaccattactgagtttagt

SEQ ID NO: 5799 - DNA, 20 bp, Homo sapiens
gatatcatcatatactgtaa

SEQ ID NO: 5800 - DNA, 19 bp, Homo sapiens
gatatcatcatatactgta

SEQ ID NO: 5801 - DNA, 22 bp, Homo sapiens
ccgttaccattactgagtttag

SEQ ID NO: 5802 - DNA, 20 bp, Homo sapiens
atcttccagtacagtgttgg

SEQ ID NO: 5803 - DNA, 21 bp, Homo sapiens
acagggtagaaccacggacag

SEQ ID NO: 5804 - DNA, 18 bp, Homo sapiens
cgttaccattactgagtt

SEQ ID NO: 5805 - DNA, 19 bp, Homo sapiens
attgcacggtatccatctg

SEQ ID NO: 5806 - DNA, 17 bp, Homo sapiens
accgttaccattactga

SEQ ID NO: 5807 - DNA, 21 bp, Homo sapiens
tgtacaaccttctagctttcc

SEQ ID NO: 5808 - DNA, 21 bp, Homo sapiens
ccatcgaccgttgagtggacc

SEQ ID NO: 5809 - DNA, 20 bp, Homo sapiens
tgctgagctagcacttcccg

SEQ ID NO: 5810 - DNA, 19 bp, Homo sapiens
gctcgtgtctgtgggtccg

SEQ ID NO: 5811 - DNA, 20 bp, Homo sapiens
tcgggaatgtcgtgtccgcc

SEQ ID NO: 5812 - DNA, 19 bp, Homo sapiens
tcgggaatgtcgtgtccgc

SEQ ID NO: 5813 - DNA, 19 bp, Homo sapiens
tgtagggatggaagccatg

SEQ ID NO: 5814 - DNA, 21 bp, Homo sapiens
tgctgagctagcacttcccga

SEQ ID NO: 5815 - DNA, 21 bp, Homo sapiens
ctattcttgattacttgtttc

SEQ ID NO: 5816 - DNA, 19 bp, Homo sapiens
ttgcatagtcacaaaagtg

SEQ ID NO: 5817 - DNA, 21 bp, Homo sapiens
ttctaggtatggtcccaggga

SEQ ID NO: 5818 - DNA, 19 bp, Homo sapiens
atcgtgcatccctttagag

SEQ ID NO: 5819 - DNA, 19 bp, Homo sapiens
ttctccaaaagaaagcact

SEQ ID NO: 5820 - DNA, 20 bp, Homo sapiens
tcgtgcatccctttagagtg

SEQ ID NO: 5821 - DNA, 21 bp, Homo sapiens
tgcattatgagcacttaaagt

SEQ ID NO: 5822 - DNA, 20 bp, Homo sapiens
gcattatgagcacttaaagt

SEQ ID NO: 5823 - DNA, 20 bp, Homo sapiens
cagttttcccaggaatccct

SEQ ID NO: 5824 - DNA, 20 bp, Homo sapiens
aatactgtctggtaaaaccg

SEQ ID NO: 5825 - DNA, 22 bp, Homo sapiens
gaggggcagagagcgagacttt

SEQ ID NO: 5826 - DNA, 24 bp, Homo sapiens
agaactgaattccatgggttgtgt

SEQ ID NO: 5827 - DNA, 21 bp, Homo sapiens
caaagtgcctccttttagagt

SEQ ID NO: 5828 - DNA, 20 bp, Homo sapiens
aaagcgcttctctttagagg

SEQ ID NO: 5829 - DNA, 19 bp, Homo sapiens
caaagcgcttctctttaga

SEQ ID NO: 5830 - DNA, 21 bp, Homo sapiens
aaggcgcttccctttggagtg

SEQ ID NO: 5831 - DNA, 21 bp, Homo sapiens
gaaggcgcttccctttggagt

SEQ ID NO: 5832 - DNA, 20 bp, Homo sapiens
ctacaaagggaagccctttc

SEQ ID NO: 5833 - DNA, 19 bp, Homo sapiens
aaggcgcttccctttagag

SEQ ID NO: 5834 - DNA, 19 bp, Homo sapiens
gagtgccttcttttggagc

SEQ ID NO: 5835 - DNA, 21 bp, Homo sapiens
agagtgccttcttttggagcg

SEQ ID NO: 5836 - DNA, 21 bp, Homo sapiens
aagaattctccttttgggctt

SEQ ID NO: 5837 - DNA, 18 bp, Homo sapiens
taggattacaagtgtcgg

SEQ ID NO: 5838 - DNA, 16 bp, Homo sapiens
acttgtcccggcctgt

SEQ ID NO: 5839 - DNA, 17 bp, Homo sapiens
gtagaaccgaccttgcg

SEQ ID NO: 5840 - DNA, 22 bp, Homo sapiens
aggtagtaagttgtattgttgt

SEQ ID NO: 5841 - DNA, 21 bp, Homo sapiens
gcagtgcaatgttaaaagggc

SEQ ID NO: 5842 - DNA, 20 bp, Homo sapiens
taggcagtgtattgctagcg

SEQ ID NO: 5843 - DNA, 17 bp, Homo sapiens
cgtagaaccgaccttgc

SEQ ID NO: 5844 - DNA, 20 bp, Homo sapiens
aatggtgccctagtgactac

SEQ ID NO: 5845 - DNA, 18 bp, Homo sapiens
acccgtagaaccgacctt

SEQ ID NO: 5846 - DNA, 19 bp, Homo sapiens
aggcagtgtattgttagct

SEQ ID NO: 5847 - DNA, 20 bp, Homo sapiens
aggcagtgtattgttagctg

SEQ ID NO: 5848 - DNA, 20 bp, Homo sapiens
agggccccccctcaatcctg

SEQ ID NO: 5849 - DNA, 15 bp, Homo sapiens
agctcggtctgaggc

SEQ ID NO: 5850 - DNA, 22 bp, Homo sapiens
ttctaatttctccacgtctttg

SEQ ID NO: 5851 - DNA, 19 bp, Homo sapiens
gatttcagtggagtgaagt

SEQ ID NO: 5852 - DNA, 18 bp, Homo sapiens
cgtaccgtgagtaataat

SEQ ID NO: 5853 - DNA, 21 bp, Homo sapiens
tacagcaggcacagacaggca

SEQ ID NO: 5854 - DNA, 20 bp, Homo sapiens
cagccttcggtacttgaaga

SEQ ID NO: 5855 - DNA, 19 bp, Homo sapiens
agcgtgtggtacttgaaga

SEQ ID NO: 5856 - DNA, 16 bp, Homo sapiens
acatcctcgactggaa

SEQ ID NO: 5857 - DNA, 19 bp, Homo sapiens
ttgcacattactaagttgc

SEQ ID NO: 5858 - DNA, 19 bp, Homo sapiens
tttatcaccagatcctaga

SEQ ID NO: 5859 - DNA, 18 bp, Homo sapiens
ctgtggtctagtgctgtg

SEQ ID NO: 5860 - DNA, 20 bp, Homo sapiens
aatggatttttggagcagga

SEQ ID NO: 5861 - DNA, 19 bp, Homo sapiens
ttattggctggaaaggaag

SEQ ID NO: 5862 - DNA, 19 bp, Homo sapiens
caggtcacgtctctgcagt

SEQ ID NO: 5863 - DNA, 17 bp, Homo sapiens
caggtcgtcttgcaggg

SEQ ID NO: 5864 - DNA, 19 bp, Homo sapiens
atggatttttggagcagga

SEQ ID NO: 5865 - DNA, 20 bp, Homo sapiens
cttattggctggaaaggaag

SEQ ID NO: 5866 - DNA, 21 bp, Homo sapiens
ctggggttctgagacagacag

SEQ ID NO: 5867 - DNA, 21 bp, Homo sapiens
ttaagatggttgggtttggat

SEQ ID NO: 5868 - DNA, 19 bp, Homo sapiens
ggtgcatctagtgcagata

SEQ ID NO: 5869 - DNA, 21 bp, Homo sapiens
tttgggactgatcttgatgtc

SEQ ID NO: 5870 - DNA, 17 bp, Homo sapiens
ccagtggggctgctgtt

SEQ ID NO: 5871 - DNA, 20 bp, Homo sapiens
ctggagatatggaagagctg

SEQ ID NO: 5872 - DNA, 23 bp, Homo sapiens
ttgggcgtatctgtatgctaggg

SEQ ID NO: 5873 - DNA, 20 bp, Homo sapiens
tgcctactgagctgatatca

SEQ ID NO: 5874 - DNA, 21 bp, Homo sapiens
tgacatcacatatacggcagc

SEQ ID NO: 5875 - DNA, 20 bp, Homo sapiens
gtgacatcacatatacggca

SEQ ID NO: 5876 - DNA, 22 bp, Homo sapiens
actgccctaagtgctccttctg

SEQ ID NO: 5877 - DNA, 27 bp, Homo sapiens
taccctgtagaaccgaatttgtgtggt

SEQ ID NO: 5878 - DNA, 20 bp, Homo sapiens
agggacgggacgcggtgcag

SEQ ID NO: 5879 - DNA, 21 bp, Homo sapiens
gtgggttggggcgggctctgg

SEQ ID NO: 5880 - DNA, 23 bp, Homo sapiens
agggactttcaggggcagctgtg

SEQ ID NO: 5881 - DNA, 22 bp, Homo sapiens
cggtttgaggctacagtgagat

SEQ ID NO: 5882 - DNA, 19 bp, Homo sapiens
ggcactggtagaattcact

SEQ ID NO: 5883 - DNA, 22 bp, Homo sapiens
aacatcacagcaagtctgtgct

SEQ ID NO: 5884 - DNA, 20 bp, Homo sapiens
atcgccgagggccggtcggc

SEQ ID NO: 5885 - DNA, 20 bp, Homo sapiens
aaattcgtatctaggggaat

SEQ ID NO: 5886 - DNA, 21 bp, Homo sapiens
actgcattatgagcacttaaa

SEQ ID NO: 5887 - DNA, 25 bp, Homo sapiens
ctgacctatgaattgacagccagtg

SEQ ID NO: 5888 - DNA, 26 bp, Homo sapiens
ctgacctatgaattgacagccagtgc

SEQ ID NO: 5889 - DNA, 23 bp, Homo sapiens
ctgtgcaaatccatgcaaaactg

SEQ ID NO: 5890 - DNA, 18 bp, Homo sapiens
tcagtcggatgtttacag

SEQ ID NO: 5891 - DNA, 22 bp, Homo sapiens
actggccctcaaagtcccgctt

SEQ ID NO: 5892 - DNA, 20 bp, Homo sapiens
aaaagtaatcactgtttttg

SEQ ID NO: 5893 - DNA, 20 bp, Homo sapiens
acctatgaattgacagccag

SEQ ID NO: 5894 - DNA, 23 bp, Homo sapiens
tatacctcagttttatcaggtgt

SEQ ID NO: 5895 - DNA, 17 bp, Homo sapiens
cctatgaattgacagcc

SEQ ID NO: 5896 - DNA, 19 bp, Homo sapiens
aagtaatccaggataggct

SEQ ID NO: 5897 - DNA, 18 bp, Homo sapiens
ttcattccaccggagtct

SEQ ID NO: 5898 - DNA, 18 bp, Homo sapiens
ttgtacatggtaggcttt

SEQ ID NO: 5899 - DNA, 18 bp, Homo sapiens
gaagttgttcgtggtgga

SEQ ID NO: 5900 - DNA, 18 bp, Homo sapiens
cgaatgttgctcggtgaa

SEQ ID NO: 5901 - DNA, 19 bp, Homo sapiens
cacattacacggtcgacct

SEQ ID NO: 5902 - DNA, 21 bp, Homo sapiens
tcagtaacaaagattcatcct

SEQ ID NO: 5903 - DNA, 21 bp, Homo sapiens
aacactgtctggtaacgatgt

SEQ ID NO: 5904 - DNA, 21 bp, Homo sapiens
ggtgcctactgagctgatatc

SEQ ID NO: 5905 - DNA, 19 bp, Homo sapiens
ggtgcagtgctgcatctct

SEQ ID NO: 5906 - DNA, 19 bp, Homo sapiens
ccagttttcccaggaatcc

SEQ ID NO: 5907 - DNA, 19 bp, Homo sapiens
agttttcccaggaatccct

SEQ ID NO: 5908 - DNA, 20 bp, Homo sapiens
ccagttttcccaggaatccc

SEQ ID NO: 5909 - DNA, 22 bp, Homo sapiens
atttgggactgatcttgatgtc

SEQ ID NO: 5910 - DNA, 23 bp, Homo sapiens
ttgggactgatcttgatgtctgc

SEQ ID NO: 5911 - DNA, 21 bp, Homo sapiens
ttgggactgatcttgatgtct

SEQ ID NO: 5912 - DNA, 22 bp, Homo sapiens
ctgtactgagctgccccgaggc

SEQ ID NO: 5913 - DNA, 23 bp, Homo sapiens
ctcacacagaaatcgcacccgtc

SEQ ID NO: 5914 - DNA, 28 bp, Homo sapiens
agatgggctttcagtcggatgtttgcag

SEQ ID NO: 5915 - DNA, 27 bp, Homo sapiens
gcttatcagactgatgttgactgttga

SEQ ID NO: 5916 - DNA, 29 bp, Homo sapiens
gcttatcagactgatgttgactgttgaat

SEQ ID NO: 5917 - DNA, 25 bp, Homo sapiens
ctcatggcaacaccagtcgatgggc

SEQ ID NO: 5918 - DNA, 24 bp, Homo sapiens
ggtgcctactgagctgatatcagt

SEQ ID NO: 5919 - DNA, 24 bp, Homo sapiens
tatggcttttcattcctatgtgat

SEQ ID NO: 5920 - DNA, 20 bp, Homo sapiens
ttggccatggggctgcgcgg

SEQ ID NO: 5921 - DNA, 18 bp, Homo sapiens
ggtcgtatgtgtgacgcc

SEQ ID NO: 5922 - DNA, 16 bp, Homo sapiens
ttgagtgtaggaccgt

SEQ ID NO: 5923 - DNA, 24 bp, Homo sapiens
tgattgtccaaacgcaattcttgt

SEQ ID NO: 5924 - DNA, 22 bp, Homo sapiens
gtggttatccctgtcctgttcg

SEQ ID NO: 5925 - DNA, 24 bp, Homo sapiens
agtctgagatgaagcactgtagct

SEQ ID NO: 5926 - DNA, 18 bp, Homo sapiens
cgggaacgtcgagactgg

SEQ ID NO: 5927 - DNA, 21 bp, Homo sapiens
cctctacagggaagcgctttc

SEQ ID NO: 5928 - DNA, 20 bp, Homo sapiens
atcacaagtcaggctcttgg

SEQ ID NO: 5929 - DNA, 23 bp, Homo sapiens
ctcccatagaggctgtggctgga

SEQ ID NO: 5930 - DNA, 22 bp, Homo sapiens
tcccatagaggctgtggctgga

SEQ ID NO: 5931 - DNA, 24 bp, Homo sapiens
gtgtcagtttgtcaaataccccaa

SEQ ID NO: 5932 - DNA, 20 bp, Homo sapiens
ggtttaccgtcccacataca

SEQ ID NO: 5933 - DNA, 20 bp, Homo sapiens
agtccatgggcatatacact

SEQ ID NO: 5934 - DNA, 22 bp, Homo sapiens
tcggcgtggcgtcggtcgtggt

SEQ ID NO: 5935 - DNA, 22 bp, Homo sapiens
cagctgcctgggagtgacttca

SEQ ID NO: 5936 - DNA, 24 bp, Homo sapiens
ctggagatatggaagagctgtgtt

SEQ ID NO: 5937 - DNA, 24 bp, Homo sapiens
actggagatatggaagagctgtgt

SEQ ID NO: 5938 - DNA, 22 bp, Homo sapiens
ctccggttctcagggctccacc

SEQ ID NO: 5939 - DNA, 19 bp, Homo sapiens
ttgcactcgtcccggcctc

SEQ ID NO: 5940 - DNA, 24 bp, Homo sapiens
agcctggaagctggagcctgcagt

SEQ ID NO: 5941 - DNA, 24 bp, Homo sapiens
agggacgggacgcggtgcagtgtt

SEQ ID NO: 5942 - DNA, 24 bp, Homo sapiens
gaatctgtgctctgggggctgtgc

SEQ ID NO: 5943 - DNA, 22 bp, Homo sapiens
accttgcgctactcaggtctgc

SEQ ID NO: 5944 - DNA, 22 bp, Homo sapiens
tccggttctcagggctccacct

SEQ ID NO: 5945 - DNA, 23 bp, Homo sapiens
actggagatatggaagagctgtg

SEQ ID NO: 5946 - DNA, 21 bp, Homo sapiens
ggcactggtagaattcactgt

SEQ ID NO: 5947 - DNA, 22 bp, Homo sapiens
gatgggtgaatttgtagaagga

SEQ ID NO: 5948 - DNA, 21 bp, Homo sapiens
aaaccatcgaccgttgattgt

SEQ ID NO: 5949 - DNA, 22 bp, Homo sapiens
aagacccattgaggagaaggtt

SEQ ID NO: 5950 - DNA, 24 bp, Homo sapiens
ttgtaaacatccccgactggaagc

SEQ ID NO: 5951 - DNA, 27 bp, Homo sapiens
tcatggcaacaccagtcgatgggctgt

SEQ ID NO: 5952 - DNA, 24 bp, Homo sapiens
tctggctccgtgtcttcactcccg

SEQ ID NO: 5953 - DNA, 20 bp, Homo sapiens
cgccattatcacactaaata

SEQ ID NO: 5954 - DNA, 17 bp, Homo sapiens
tgtagatccgaatttgt

SEQ ID NO: 5955 - DNA, 22 bp, Homo sapiens
aaaagctgggttgagagggtag

SEQ ID NO: 5956 - DNA, 25 bp, Homo sapiens
ggggtgctatctgtgattgagggac

SEQ ID NO: 5957 - DNA, 20 bp, Homo sapiens
tttctgtggtacttgaagag

SEQ ID NO: 5958 - DNA, 19 bp, Homo sapiens
aaacgccattatcacacta

SEQ ID NO: 5959 - DNA, 19 bp, Homo sapiens
aatcgtacagggtcatcca

SEQ ID NO: 5960 - DNA, 21 bp, Homo sapiens
ttggagtaggtcattgggtgg

SEQ ID NO: 5961 - DNA, 19 bp, Homo sapiens
aatgttgctcggtgaaccc

SEQ ID NO: 5962 - DNA, 23 bp, Homo sapiens
aatcattcacggacaacactttt

SEQ ID NO: 5963 - DNA, 25 bp, Homo sapiens
tgattgtagccttttggagtagagt

SEQ ID NO: 5964 - DNA, 21 bp, Homo sapiens
gctggtcaaacggaaccaagt

SEQ ID NO: 5965 - DNA, 19 bp, Homo sapiens
aagaggtatagggcatggg

SEQ ID NO: 5966 - DNA, 16 bp, Homo sapiens
accttcttgtataagc

SEQ ID NO: 5967 - DNA, 19 bp, Homo sapiens
gtcatacacggctctcctc

SEQ ID NO: 5968 - DNA, 19 bp, Homo sapiens
gcggggcgccgcgggaccg

SEQ ID NO: 5969 - DNA, 21 bp, Homo sapiens
acacacctggttaacctcttt

SEQ ID NO: 5970 - DNA, 21 bp, Homo sapiens
acgccattatcacactaaata

SEQ ID NO: 5971 - DNA, 20 bp, Homo sapiens
catacaatgtagatttctgt

SEQ ID NO: 5972 - DNA, 18 bp, Homo sapiens
tccagcatcagtgatttt

SEQ ID NO: 5973 - DNA, 20 bp, Homo sapiens
atggcgccactagggttgtg

SEQ ID NO: 5974 - DNA, 22 bp, Homo sapiens
taaacatccttgactggaagct

SEQ ID NO: 5975 - DNA, 19 bp, Homo sapiens
agaggtagtaggttgcata

SEQ ID NO: 5976 - DNA, 19 bp, Homo sapiens
ctgttgccactaacctcaa

SEQ ID NO: 5977 - DNA, 18 bp, Homo sapiens
gtgtagttagctgattgc

SEQ ID NO: 5978 - DNA, 21 bp, Homo sapiens
cagtgcctcggcagtgcagcc

SEQ ID NO: 5979 - DNA, 18 bp, Homo sapiens
tgaggtagtaagttgtat

SEQ ID NO: 5980 - DNA, 18 bp, Homo sapiens
gtcatacacggctctcct

SEQ ID NO: 5981 - DNA, 26 bp, Homo sapiens
ggccgcgctcgaggggtccccgtggc

SEQ ID NO: 5982 - DNA, 27 bp, Homo sapiens
ccggacaggcgttcgtgcgacgtgtgg

SEQ ID NO: 5983 - DNA, 18 bp, Homo sapiens
ctccagccctgccggggc

SEQ ID NO: 5984 - DNA, 16 bp, Homo sapiens
ttatcagaatctccag

SEQ ID NO: 5985 - DNA, 17 bp, Homo sapiens
tttgtcaaataccccaa

SEQ ID NO: 5986 - DNA, 17 bp, Homo sapiens
tgaaggtctactgtgtg

SEQ ID NO: 5987 - DNA, 22 bp, Homo sapiens
ctcacacagaaatcgcacccgt

SEQ ID NO: 5988 - DNA, 19 bp, Homo sapiens
ttgacacttctgtgagtag

SEQ ID NO: 5989 - DNA, 18 bp, Homo sapiens
attgacacttctgtgagt

SEQ ID NO: 5990 - DNA, 17 bp, Homo sapiens
tttaaatagtgattgtc

SEQ ID NO: 5991 - DNA, 20 bp, Homo sapiens
acaacaaatcccagtctacc

SEQ ID NO: 5992 - DNA, 20 bp, Homo sapiens
gagcttattcataaaagtgc

SEQ ID NO: 5993 - DNA, 19 bp, Homo sapiens
cttggcacctagcaagcac

SEQ ID NO: 5994 - DNA, 21 bp, Homo sapiens
ctacagtgcacgtgtctccag

SEQ ID NO: 5995 - DNA, 16 bp, Homo sapiens
gtagatccgaacttgt

SEQ ID NO: 5996 - DNA, 23 bp, Homo sapiens
tgtgactggttgaccagaggggc

SEQ ID NO: 5997 - DNA, 22 bp, Homo sapiens
accctatcaatattgtctctgc

SEQ ID NO: 5998 - DNA, 22 bp, Homo sapiens
aggtggtccgtggcgcgttcgc

SEQ ID NO: 5999 - DNA, 23 bp, Homo sapiens
atcatacaaggacaatttctttt

SEQ ID NO: 6000 - DNA, 23 bp, Homo sapiens
gcctgctggggtggaacctggtc

SEQ ID NO: 6001 - DNA, 21 bp, Homo sapiens
cctgctggggtggaacctggt

SEQ ID NO: 6002 - DNA, 24 bp, Homo sapiens
tgtttaaccttttgcctgttggtt

SEQ ID NO: 6003 - DNA, 19 bp, Homo sapiens
catacaatgtagatttctg

SEQ ID NO: 6004 - DNA, 18 bp, Homo sapiens
agaggtagtaggttgcat

SEQ ID NO: 6005 - DNA, 17 bp, Homo sapiens
cagtcggatgtttgcag

SEQ ID NO: 6006 - DNA, 16 bp, Homo sapiens
gaatgttgctcggtga

SEQ ID NO: 6007 - DNA, 24 bp, Homo sapiens
tagagagcactgagcgacagatac

SEQ ID NO: 6008 - DNA, 19 bp, Homo sapiens
caaagcacacggcctgcag

SEQ ID NO: 6009 - DNA, 18 bp, Homo sapiens
tcctggcgggcagctgtg

SEQ ID NO: 6010 - DNA, 19 bp, Homo sapiens
tcgattggacccgccctcc

SEQ ID NO: 6011 - DNA, 26 bp, Homo sapiens
aggcagtgtattgctagcggctgtta

SEQ ID NO: 6012 - DNA, 24 bp, Homo sapiens
taggcagtgtattgctagcggctg

SEQ ID NO: 6013 - DNA, 27 bp, Homo sapiens
aggcagtgtattgttagctggctgctt

SEQ ID NO: 6014 - DNA, 23 bp, Homo sapiens
attgcacttgtcccggcctgttg

SEQ ID NO: 6015 - DNA, 21 bp, Homo sapiens
attcaagtaatccaggatagg

SEQ ID NO: 6016 - DNA, 23 bp, Homo sapiens
acccagtgttcagactacctgtt

SEQ ID NO: 6017 - DNA, 19 bp, Homo sapiens
tcaagtaatccaggatagg

SEQ ID NO: 6018 - DNA, 18 bp, Homo sapiens
ccctgtagaaccgaattt

SEQ ID NO: 6019 - DNA, 15 bp, Homo sapiens
gtttaggaccactag

SEQ ID NO: 6020 - DNA, 20 bp, Homo sapiens
gaggtaggaggttgtatagt

SEQ ID NO: 6021 - DNA, 18 bp, Homo sapiens
cagcacgtaaatattggc

SEQ ID NO: 6022 - DNA, 21 bp, Homo sapiens
ggcagtgtattgttagctggt

SEQ ID NO: 6023 - DNA, 21 bp, Homo sapiens
ttggggaaacggccgctgagt

SEQ ID NO: 6024 - DNA, 23 bp, Homo sapiens
tgggtctttgcgggcgagatgag

SEQ ID NO: 6025 - DNA, 22 bp, Homo sapiens
tcggcaacaagaaactgcctga

SEQ ID NO: 6026 - DNA, 23 bp, Homo sapiens
tgattaatatcggacaaccattg

SEQ ID NO: 6027 - DNA, 21 bp, Homo sapiens
taacgcataatatggacatgt

SEQ ID NO: 6028 - DNA, 22 bp, Homo sapiens
actgattatcttaactctctga

SEQ ID NO: 6029 - DNA, 20 bp, Homo sapiens
cgtgtatttgacaagctgag

SEQ ID NO: 6030 - DNA, 22 bp, Homo sapiens
ggaggaaccttggagcttcggc

SEQ ID NO: 6031 - DNA, 25 bp, Homo sapiens
cagcactagattgtaaagactgggg

SEQ ID NO: 6032 - DNA, 21 bp, Homo sapiens
tgaattaccgaagggccataa

SEQ ID NO: 6033 - DNA, 20 bp, Homo sapiens
ctcgtgggctctggccacgg

SEQ ID NO: 6034 - DNA, 27 bp, Homo sapiens
catcttaccggacagtgctggatttcc

SEQ ID NO: 6035 - DNA, 25 bp, Homo sapiens
ctctgaagaaatcctactcggatgg

SEQ ID NO: 6036 - DNA, 28 bp, Homo sapiens
cccggacaggcgttcgtgcgacgtgtgg

SEQ ID NO: 6037 - DNA, 26 bp, Homo sapiens
cctagagagcactgagcgacagatac

SEQ ID NO: 6038 - DNA, 24 bp, Homo sapiens
gcttatcagactgatgttgactgt

SEQ ID NO: 6039 - DNA, 25 bp, Homo sapiens
gcttatcagactgatgttgactgtt

SEQ ID NO: 6040 - DNA, 26 bp, Homo sapiens
gcttatcagactgatgttgactgttg

SEQ ID NO: 6041 - DNA, 26 bp, Homo sapiens
ttcaagtaatccaggataggctgttt

SEQ ID NO: 6042 - DNA, 23 bp, Homo sapiens
tggcaacaccagtcgatgggctg

SEQ ID NO: 6043 - DNA, 27 bp, Homo sapiens
ggccgcgctcgaggggtccccgtggcg

SEQ ID NO: 6044 - DNA, 25 bp, Homo sapiens
cgcgggaccgccctcgtgtctgtgg

SEQ ID NO: 6045 - DNA, 28 bp, Homo sapiens
aacattcattgctgtcggtgggttgaac

SEQ ID NO: 6046 - DNA, 26 bp, Homo sapiens
cagcactagattgtaaagactggggt

SEQ ID NO: 6047 - DNA, 23 bp, Homo sapiens
accttcttgtataagcactgtgc

SEQ ID NO: 6048 - DNA, 26 bp, Homo sapiens
accttcttgtataagcactgtgctaa

SEQ ID NO: 6049 - DNA, 26 bp, Homo sapiens
gtggcgtccccttccccgccggccgc

SEQ ID NO: 6050 - DNA, 26 bp, Homo sapiens
cccgtggcgtccccttccccgccggc

SEQ ID NO: 6051 - DNA, 29 bp, Homo sapiens
attcatgatactgtaaacgctttctgatg

SEQ ID NO: 6052 - DNA, 26 bp, Homo sapiens
ccgcgggaccgccctcgtgtctgtgg

SEQ ID NO: 6053 - DNA, 19 bp, Homo sapiens
caacaggtgactggttaga

SEQ ID NO: 6054 - DNA, 19 bp, Homo sapiens
catcccttgcatggtggag

SEQ ID NO: 6055 - DNA, 23 bp, Homo sapiens
cggctacttcacaacaccagggc

SEQ ID NO: 6056 - DNA, 20 bp, Homo sapiens
tccggttctcagggctccac

SEQ ID NO: 6057 - DNA, 20 bp, Homo sapiens
tcacacagaaatcgcacccg

SEQ ID NO: 6058 - DNA, 20 bp, Homo sapiens
atggtagaactcacactggt

SEQ ID NO: 6059 - DNA, 27 bp, Homo sapiens
caaccagatttcagtggagtgaagttc

SEQ ID NO: 6060 - DNA, 26 bp, Homo sapiens
cccaaccagatttcagtggagtgaag

SEQ ID NO: 6061 - DNA, 20 bp, Homo sapiens
ccccaggcctcgctgttctc

SEQ ID NO: 6062 - DNA, 20 bp, Homo sapiens
accccactcctggtaccata

SEQ ID NO: 6063 - DNA, 21 bp, Homo sapiens
tcaccagccctgtgttcccta

SEQ ID NO: 6064 - DNA, 18 bp, Homo sapiens
tttccggctcgcgtgggt

SEQ ID NO: 6065 - DNA, 17 bp, Homo sapiens
ctgtctggtaaagatgg

SEQ ID NO: 6066 - DNA, 17 bp, Homo sapiens
ctgccgggtaatgatgg

SEQ ID NO: 6067 - DNA, 21 bp, Homo sapiens
ggcagtgtcttagctggttgt

SEQ ID NO: 6068 - DNA, 29 bp, Homo sapiens
ctcatggcaacaccagtcgatgggctgtc

SEQ ID NO: 6069 - DNA, 18 bp, Homo sapiens
tgattgtccaaacgcaat

SEQ ID NO: 6070 - DNA, 20 bp, Homo sapiens
gtgaggtagtaggttgtata

SEQ ID NO: 6071 - DNA, 19 bp, Homo sapiens
ttaaggcacgcggtgaatg

SEQ ID NO: 6072 - DNA, 29 bp, Homo sapiens
aacattcaacgctgtcggtgagtttggga

SEQ ID NO: 6073 - DNA, 25 bp, Homo sapiens
ccttgggagccctgttagactctgg

SEQ ID NO: 6074 - DNA, 24 bp, Homo sapiens
aaaccactgaccgttgactgtacc

SEQ ID NO: 6075 - DNA, 26 bp, Homo sapiens
gaaaaaaccactgaccgttgactgta

SEQ ID NO: 6076 - DNA, 25 bp, Homo sapiens
aaaaccactgaccgttgactgtacc

SEQ ID NO: 6077 - DNA, 28 bp, Homo sapiens
gaaaaaaccactgaccgttgactgtacc

SEQ ID NO: 6078 - DNA, 26 bp, Homo sapiens
ctccatggctgtaccaccttgtcggg

SEQ ID NO: 6079 - DNA, 25 bp, Homo sapiens
tagcagcacagaaatattggcacag

SEQ ID NO: 6080 - DNA, 27 bp, Homo sapiens
ccgaccctgagctctgccaccgaggat

SEQ ID NO: 6081 - DNA, 20 bp, Homo sapiens
ccactgccccaggtgctgct

SEQ ID NO: 6082 - DNA, 23 bp, Homo sapiens
gtattgcacttgtcccggcctgt

SEQ ID NO: 6083 - DNA, 21 bp, Homo sapiens
actgccctaaatgccccttct

SEQ ID NO: 6084 - DNA, 20 bp, Homo sapiens
actgccctaaatgccccttc

SEQ ID NO: 6085 - DNA, 21 bp, Homo sapiens
aaagctgggttgagagggcaa

SEQ ID NO: 6086 - DNA, 20 bp, Homo sapiens
tactgccctaaatgcccctt

SEQ ID NO: 6087 - DNA, 21 bp, Homo sapiens
tactgccctaaatgccccttc

SEQ ID NO: 6088 - DNA, 18 bp, Homo sapiens
tactgccctaaatgcccc

SEQ ID NO: 6089 - DNA, 22 bp, Homo sapiens
tactgccctaaatgccccttct

SEQ ID NO: 6090 - DNA, 20 bp, Homo sapiens
aaaagctgggttgagaggag

SEQ ID NO: 6091 - DNA, 21 bp, Homo sapiens
cgcccgagcgcggcccggtgg

SEQ ID NO: 6092 - DNA, 22 bp, Homo sapiens
aagttgcccgtgtttttttcgc

SEQ ID NO: 6093 - DNA, 22 bp, Homo sapiens
atcattcacggacaacactttt

SEQ ID NO: 6094 - DNA, 20 bp, Homo sapiens
tggatattccttctatgttt

SEQ ID NO: 6095 - DNA, 20 bp, Homo sapiens
aagttgttcgtggtggattc

SEQ ID NO: 6096 - DNA, 22 bp, Homo sapiens
atacaaggacaatttctttttg

SEQ ID NO: 6097 - DNA, 22 bp, Homo sapiens
agttgcccgtgtttttttcgct

SEQ ID NO: 6098 - DNA, 22 bp, Homo sapiens
tccagtaccacgtgtcagggcc

SEQ ID NO: 6099 - DNA, 19 bp, Homo sapiens
tccagtaccacgtgtcagg

SEQ ID NO: 6100 - DNA, 19 bp, Homo sapiens
ggtagtttcatgttgttgg

SEQ ID NO: 6101 - DNA, 22 bp, Homo sapiens
taaacatcctacactctcagct

SEQ ID NO: 6102 - DNA, 21 bp, Homo sapiens
tgcaaatccatgcaaaactga

SEQ ID NO: 6103 - DNA, 20 bp, Homo sapiens
aacatccttgactggaagct

SEQ ID NO: 6104 - DNA, 21 bp, Homo sapiens
taacagcaactccatgtggaa

SEQ ID NO: 6105 - DNA, 19 bp, Homo sapiens
caagtcactagtggttccg

SEQ ID NO: 6106 - DNA, 19 bp, Homo sapiens
ccactgaccgttgactgta

SEQ ID NO: 6107 - DNA, 17 bp, Homo sapiens
ttatggtttgcctggga

SEQ ID NO: 6108 - DNA, 17 bp, Homo sapiens
ctgtctggtaacgatgt

SEQ ID NO: 6109 - DNA, 18 bp, Homo sapiens
tgcatcacagaactttgt

SEQ ID NO: 6110 - DNA, 22 bp, Homo sapiens
caccagtcgatgggctgtctga

SEQ ID NO: 6111 - DNA, 22 bp, Homo sapiens
tggatgttggcctagttctgtg

SEQ ID NO: 6112 - DNA, 23 bp, Homo sapiens
ctagactgaagctccttgaggac

SEQ ID NO: 6113 - DNA, 16 bp, Homo sapiens
tgcactacagaacttt

SEQ ID NO: 6114 - DNA, 23 bp, Homo sapiens
ttaccagacatggttagacctgg

SEQ ID NO: 6115 - DNA, 21 bp, Homo sapiens
ggtagtttcatgttgttggga

SEQ ID NO: 6116 - DNA, 23 bp, Homo sapiens
agctacagttacttttgcaccag

SEQ ID NO: 6117 - DNA, 22 bp, Homo sapiens
cctccgtgttacctgtcctcta

SEQ ID NO: 6118 - DNA, 22 bp, Homo sapiens
ccctgtggactcagttctggtg

SEQ ID NO: 6119 - DNA, 24 bp, Homo sapiens
gaagttctgttatacactcaggct

SEQ ID NO: 6120 - DNA, 19 bp, Homo sapiens
agctggtgttgtgaatcag

SEQ ID NO: 6121 - DNA, 20 bp, Homo sapiens
actggccctcaaagtcccgc

SEQ ID NO: 6122 - DNA, 24 bp, Homo sapiens
ggagaaattatccttggtgtgttc

SEQ ID NO: 6123 - DNA, 19 bp, Homo sapiens
aaagtgctgacagtgcaga

SEQ ID NO: 6124 - DNA, 25 bp, Homo sapiens
tgaggtagtaggttgtatagtttgg

SEQ ID NO: 6125 - DNA, 19 bp, Homo sapiens
agtgtagttagctgattgc

SEQ ID NO: 6126 - DNA, 20 bp, Homo sapiens
aattgtggctggacatctgt

SEQ ID NO: 6127 - DNA, 19 bp, Homo sapiens
tgcccctaaaaatccttat

SEQ ID NO: 6128 - DNA, 22 bp, Homo sapiens
tccccgacaccatggccctggc

SEQ ID NO: 6129 - DNA, 21 bp, Homo sapiens
ccctagaatggggattgtggg

SEQ ID NO: 6130 - DNA, 21 bp, Homo sapiens
tctgtcggccggccctgggtc

SEQ ID NO: 6131 - DNA, 19 bp, Homo sapiens
cctcccacacccaaggctt

SEQ ID NO: 6132 - DNA, 20 bp, Homo sapiens
atgtagggatggaagccatg

SEQ ID NO: 6133 - DNA, 21 bp, Homo sapiens
taaggcacccttctgagtaga

SEQ ID NO: 6134 - DNA, 19 bp, Homo sapiens
tgtagccttttggagtaga

SEQ ID NO: 6135 - DNA, 20 bp, Homo sapiens
ggtagtagtttgtacagttt

SEQ ID NO: 6136 - DNA, 23 bp, Homo sapiens
gaggtgcagtgctgcatctctgg

SEQ ID NO: 6137 - DNA, 20 bp, Homo sapiens
tatcagactgatgttgactg

SEQ ID NO: 6138 - DNA, 22 bp, Homo sapiens
aagctacagttacttttgcacc

SEQ ID NO: 6139 - DNA, 24 bp, Homo sapiens
gtgaggtagtaggttgtatagttt

SEQ ID NO: 6140 - DNA, 21 bp, Homo sapiens
tataatacaacctgctaagtg

SEQ ID NO: 6141 - DNA, 17 bp, Homo sapiens
cattccaccggagtctg

SEQ ID NO: 6142 - DNA, 28 bp, Homo sapiens
tttggcaatggtagaactcacactggtg

SEQ ID NO: 6143 - DNA, 22 bp, Homo sapiens
ttcttacccaccatggccaaaa

SEQ ID NO: 6144 - DNA, 19 bp, Homo sapiens
actgccccaggtgctgctg

SEQ ID NO: 6145 - DNA, 23 bp, Homo sapiens
actctagctgccaaaggcgcttc

SEQ ID NO: 6146 - DNA, 22 bp, Homo sapiens
tgccctgcctgttttctccttt

SEQ ID NO: 6147 - DNA, 18 bp, Homo sapiens
taggtagtttcctgttgt

SEQ ID NO: 6148 - DNA, 18 bp, Homo sapiens
gctgccagttgaagaact

SEQ ID NO: 6149 - DNA, 26 bp, Homo sapiens
ttcatgatactgtaaacgctttctga

SEQ ID NO: 6150 - DNA, 25 bp, Homo sapiens
ggtgcagtgctgcatctctggtcag

SEQ ID NO: 6151 - DNA, 19 bp, Homo sapiens
gttcacagtggctaagttc

SEQ ID NO: 6152 - DNA, 19 bp, Homo sapiens
gacctctgaaattcagttc

SEQ ID NO: 6153 - DNA, 20 bp, Homo sapiens
aagcccttaccccaaaaagt

SEQ ID NO: 6154 - DNA, 21 bp, Homo sapiens
ctgaggagatcgtcgaggttg

SEQ ID NO: 6155 - DNA, 18 bp, Homo sapiens
tggacggagaactgataa

SEQ ID NO: 6156 - DNA, 17 bp, Homo sapiens
aatccttggaacctagg

SEQ ID NO: 6157 - DNA, 18 bp, Homo sapiens
aatccttggaacctaggt

SEQ ID NO: 6158 - DNA, 16 bp, Homo sapiens
aatccttggaacctag

SEQ ID NO: 6159 - DNA, 19 bp, Homo sapiens
gtaaggcacccttctgagt

SEQ ID NO: 6160 - DNA, 18 bp, Homo sapiens
tttcagtggagtgaagtt

SEQ ID NO: 6161 - DNA, 19 bp, Homo sapiens
tgtccttcattccaccgga

SEQ ID NO: 6162 - DNA, 19 bp, Homo sapiens
tgtctcatacccaaccaga

SEQ ID NO: 6163 - DNA, 23 bp, Homo sapiens
atttcagtggagtgaagttcagg

SEQ ID NO: 6164 - DNA, 20 bp, Homo sapiens
gtgaacgggcgccatcccga

SEQ ID NO: 6165 - DNA, 20 bp, Homo sapiens
tggtccccttcaaccagctg

SEQ ID NO: 6166 - DNA, 21 bp, Homo sapiens
attaatatcggacaaccattg

SEQ ID NO: 6167 - DNA, 21 bp, Homo sapiens
tgcctgctggggtggaacctg

SEQ ID NO: 6168 - DNA, 19 bp, Homo sapiens
tctacagtgcacgtgtctc

SEQ ID NO: 6169 - DNA, 23 bp, Homo sapiens
aaaggattctgctgtcggtccca

SEQ ID NO: 6170 - DNA, 21 bp, Homo sapiens
aaaggattctgctgtcggtcc

SEQ ID NO: 6171 - DNA, 19 bp, Homo sapiens
taggttatccgtgttgcct

SEQ ID NO: 6172 - DNA, 20 bp, Homo sapiens
atggttgaccatagaacatg

SEQ ID NO: 6173 - DNA, 21 bp, Homo sapiens
cagtggccagagccctgcagt

SEQ ID NO: 6174 - DNA, 20 bp, Homo sapiens
cggcgtggcgtcggtcgtgg

SEQ ID NO: 6175 - DNA, 23 bp, Homo sapiens
cggccccacgcaccagggtaaga

SEQ ID NO: 6176 - DNA, 20 bp, Homo sapiens
tactgcagacgtggcaatca

SEQ ID NO: 6177 - DNA, 22 bp, Homo sapiens
agcttccatgactcctgatgga

SEQ ID NO: 6178 - DNA, 20 bp, Homo sapiens
ggccgcgctcgaggggtccc

SEQ ID NO: 6179 - DNA, 21 bp, Homo sapiens
ggccgcgctcgaggggtcccc

SEQ ID NO: 6180 - DNA, 18 bp, Homo sapiens
ggccgcgctcgaggggtc

SEQ ID NO: 6181 - DNA, 20 bp, Homo sapiens
atgtggccagcttgactaag

SEQ ID NO: 6182 - DNA, 21 bp, Homo sapiens
ggatcgccgagggccggtcgg

SEQ ID NO: 6183 - DNA, 19 bp, Homo sapiens
gttcggcgcgcgcgtgcgc

SEQ ID NO: 6184 - DNA, 21 bp, Homo sapiens
tggcgtccccttccccgccgg

SEQ ID NO: 6185 - DNA, 19 bp, Homo sapiens
tccggtgcacattgtaggc

SEQ ID NO: 6186 - DNA, 22 bp, Homo sapiens
gggatcgccgagggccggtcgg

SEQ ID NO: 6187 - DNA, 19 bp, Homo sapiens
gcgtccccttccccgccgg

SEQ ID NO: 6188 - DNA, 22 bp, Homo sapiens
gtggcgtccccttccccgccgg

SEQ ID NO: 6189 - DNA, 22 bp, Homo sapiens
tttgtaaggcacccttctgagt

SEQ ID NO: 6190 - DNA, 22 bp, Homo sapiens
acaacaacattaaaccacccga

SEQ ID NO: 6191 - DNA, 20 bp, Homo sapiens
tgtctcccaacccttgtacc

SEQ ID NO: 6192 - DNA, 19 bp, Homo sapiens
cctgccgcgccccccgggc

SEQ ID NO: 6193 - DNA, 18 bp, Homo sapiens
ctgtaaacgctttctgat

SEQ ID NO: 6194 - DNA, 17 bp, Homo sapiens
ctgtaaacgctttctga

SEQ ID NO: 6195 - DNA, 21 bp, Homo sapiens
aaaattgcagacactaggacc

SEQ ID NO: 6196 - DNA, 17 bp, Homo sapiens
ctgaattccataggctg

SEQ ID NO: 6197 - DNA, 21 bp, Homo sapiens
ccccacctcctctctcctcag

SEQ ID NO: 6198 - DNA, 20 bp, Homo sapiens
ctcgtaccgtgagtaataat

SEQ ID NO: 6199 - DNA, 20 bp, Homo sapiens
gtttttcattattgctcctg

SEQ ID NO: 6200 - DNA, 20 bp, Homo sapiens
tcgaggactggtggaagggc

SEQ ID NO: 6201 - DNA, 21 bp, Homo sapiens
agggttgggtggaggctctcc

SEQ ID NO: 6202 - DNA, 19 bp, Homo sapiens
agggccccccctcaatcct

SEQ ID NO: 6203 - DNA, 18 bp, Homo sapiens
ctgccgcgccccccgggc

SEQ ID NO: 6204 - DNA, 24 bp, Homo sapiens
tggtcgaccagttggaaagtaatt

SEQ ID NO: 6205 - DNA, 24 bp, Homo sapiens
ggcttctttacagtgctgccttgt

SEQ ID NO: 6206 - DNA, 19 bp, Homo sapiens
aatgctcagactcctgtgg

SEQ ID NO: 6207 - DNA, 16 bp, Homo sapiens
gtttaggaccactaga

SEQ ID NO: 6208 - DNA, 17 bp, Homo sapiens
tactgcctggtaatgat

SEQ ID NO: 6209 - DNA, 22 bp, Homo sapiens
tggtgcggagagggcccacagt

SEQ ID NO: 6210 - DNA, 20 bp, Homo sapiens
tgcacttgtcccggcctgtt

SEQ ID NO: 6211 - DNA, 19 bp, Homo sapiens
gcacttgtcccggcctgtt

SEQ ID NO: 6212 - DNA, 17 bp, Homo sapiens
catgccttgagtgtagg

SEQ ID NO: 6213 - DNA, 18 bp, Homo sapiens
tcacagtggctaagttcc

SEQ ID NO: 6214 - DNA, 20 bp, Homo sapiens
ggcaatggtagaactcacac

SEQ ID NO: 6215 - DNA, 21 bp, Homo sapiens
cctgtagaaccgaatttgtgt

SEQ ID NO: 6216 - DNA, 23 bp, Homo sapiens
cttccctttgtcatccttcgcct

SEQ ID NO: 6217 - DNA, 18 bp, Homo sapiens
agactgtgagcttctaga

SEQ ID NO: 6218 - DNA, 20 bp, Homo sapiens
cctctacagggaagcgcttt

SEQ ID NO: 6219 - DNA, 18 bp, Homo sapiens
ttctcgaggaaagaagca

SEQ ID NO: 6220 - DNA, 19 bp, Homo sapiens
aaaatggttccctttagag

SEQ ID NO: 6221 - DNA, 20 bp, Homo sapiens
caaagcgcttccctttggag

SEQ ID NO: 6222 - DNA, 19 bp, Homo sapiens
gagaattgtggctggacat

SEQ ID NO: 6223 - DNA, 21 bp, Homo sapiens
caaagcacacggcctgcagag

SEQ ID NO: 6224 - DNA, 18 bp, Homo sapiens
tagactgaagctccttga

SEQ ID NO: 6225 - DNA, 21 bp, Homo sapiens
cctcacacctgcctcgccccc

SEQ ID NO: 6226 - DNA, 21 bp, Homo sapiens
gtagaggagatggcgcagggg

SEQ ID NO: 6227 - DNA, 22 bp, Homo sapiens
caccttgccttgctgcccgggc

SEQ ID NO: 6228 - DNA, 20 bp, Homo sapiens
caccttgccttgctgcccgg

SEQ ID NO: 6229 - DNA, 21 bp, Homo sapiens
actcccagggactgccttagg

SEQ ID NO: 6230 - DNA, 19 bp, Homo sapiens
gtgcctactgagctgaaac

SEQ ID NO: 6231 - DNA, 23 bp, Homo sapiens
ctggacttggagtcagaaggcct

SEQ ID NO: 6232 - DNA, 25 bp, Homo sapiens
accccgggaacgtcgagactggagc

SEQ ID NO: 6233 - DNA, 20 bp, Homo sapiens
gaactgaattccatgggttg

SEQ ID NO: 6234 - DNA, 20 bp, Homo sapiens
gaaagcgcttccctttgctg

SEQ ID NO: 6235 - DNA, 16 bp, Homo sapiens
ctgtaacagcaactcc

SEQ ID NO: 6236 - DNA, 19 bp, Homo sapiens
ggactgccgggtgaccctg

SEQ ID NO: 6237 - DNA, 21 bp, Homo sapiens
atggctgtaccaccttgtcgg

SEQ ID NO: 6238 - DNA, 19 bp, Homo sapiens
ctggtttcacatggtggct

SEQ ID NO: 6239 - DNA, 19 bp, Homo sapiens
cacttggatctgaaggctg

SEQ ID NO: 6240 - DNA, 21 bp, Homo sapiens
cacttggatctgaaggctgcc

SEQ ID NO: 6241 - DNA, 21 bp, Homo sapiens
ccacttggatctgaaggctgc

SEQ ID NO: 6242 - DNA, 21 bp, Homo sapiens
tgcacccgggcaaggattctg

SEQ ID NO: 6243 - DNA, 18 bp, Homo sapiens
gccctgtggactcagttc

SEQ ID NO: 6244 - DNA, 20 bp, Homo sapiens
cactctgggtacctgagaag

SEQ ID NO: 6245 - DNA, 20 bp, Homo sapiens
tggttgaccagagagcacac

SEQ ID NO: 6246 - DNA, 21 bp, Homo sapiens
ctcattctggcctccagggct

SEQ ID NO: 6247 - DNA, 20 bp, Homo sapiens
ctttcctggtacttgaaggg

SEQ ID NO: 6248 - DNA, 19 bp, Homo sapiens
agtcaggtactcgaatgga

SEQ ID NO: 6249 - DNA, 20 bp, Homo sapiens
tctaagaagttgactgaagg

SEQ ID NO: 6250 - DNA, 21 bp, Homo sapiens
cttgttcagaaagtctgttgt

SEQ ID NO: 6251 - DNA, 23 bp, Homo sapiens
aaaccatcgaccgttgattgtac

SEQ ID NO: 6252 - DNA, 21 bp, Homo sapiens
tactgcagacagtggcaatca

SEQ ID NO: 6253 - DNA, 18 bp, Homo sapiens
ctggccctctctgccctt

SEQ ID NO: 6254 - DNA, 15 bp, Homo sapiens
tcgaccggacctcga

SEQ ID NO: 6255 - DNA, 19 bp, Homo sapiens
aacgcacttccctttagag

SEQ ID NO: 6256 - DNA, 21 bp, Homo sapiens
acgcacttccctttagagtgt

SEQ ID NO: 6257 - DNA, 20 bp, Homo sapiens
aagtgcatccttttagagtg

SEQ ID NO: 6258 - DNA, 19 bp, Homo sapiens
aatggttccctttagagtg

SEQ ID NO: 6259 - DNA, 17 bp, Homo sapiens
atctggaggtaagaagc

SEQ ID NO: 6260 - DNA, 18 bp, Homo sapiens
aacgcacttccctttaga

SEQ ID NO: 6261 - DNA, 20 bp, Homo sapiens
aaatggttccctttagagtg

SEQ ID NO: 6262 - DNA, 18 bp, Homo sapiens
aaagtgcatccttttaga

SEQ ID NO: 6263 - DNA, 20 bp, Homo sapiens
aaatcgcttccctttggagt

SEQ ID NO: 6264 - DNA, 17 bp, Homo sapiens
actctagagggaagcgc

SEQ ID NO: 6265 - DNA, 20 bp, Homo sapiens
cgcacttccctttagagtgt

SEQ ID NO: 6266 - DNA, 21 bp, Homo sapiens
aagtgcttccctttggtgaat

SEQ ID NO: 6267 - DNA, 22 bp, Homo sapiens
gaaatcgcttccctttggagtg

SEQ ID NO: 6268 - DNA, 20 bp, Homo sapiens
gaaatcgcttccctttggag

SEQ ID NO: 6269 - DNA, 16 bp, Homo sapiens
ttctcgaggaaagaag

SEQ ID NO: 6270 - DNA, 20 bp, Homo sapiens
ctacaaaggaaagcgctttc

SEQ ID NO: 6271 - DNA, 19 bp, Homo sapiens
atccgcgctctgactctct

SEQ ID NO: 6272 - DNA, 22 bp, Homo sapiens
cccatccgcgctctgactctct

SEQ ID NO: 6273 - DNA, 17 bp, Homo sapiens
aatactgcctggtaatg

SEQ ID NO: 6274 - DNA, 21 bp, Homo sapiens
gagggttgggtggaggctctc

SEQ ID NO: 6275 - DNA, 19 bp, Homo sapiens
agggttgggtggaggctct

SEQ ID NO: 6276 - DNA, 18 bp, Homo sapiens
caagtcactagtggttcc

SEQ ID NO: 6277 - DNA, 20 bp, Homo sapiens
cttcattccaccggagtctg

SEQ ID NO: 6278 - DNA, 20 bp, Homo sapiens
ctgctcataccccatggttt

SEQ ID NO: 6279 - DNA, 20 bp, Homo sapiens
atgcaccatggttgtctgag

SEQ ID NO: 6280 - DNA, 22 bp, Homo sapiens
acagcagcaattcatgttttga

SEQ ID NO: 6281 - DNA, 26 bp, Homo sapiens
agggcttagctgcttgtgagcagggt

SEQ ID NO: 6282 - DNA, 24 bp, Homo sapiens
catggcaacaccagtcgatgggct

SEQ ID NO: 6283 - DNA, 19 bp, Homo sapiens
ttgcacggtatccatctgt

SEQ ID NO: 6284 - DNA, 21 bp, Homo sapiens
agtccatgggcatatacactt

SEQ ID NO: 6285 - DNA, 23 bp, Homo sapiens
ttttggcaatggtagaactcaca

SEQ ID NO: 6286 - DNA, 17 bp, Homo sapiens
tcattccaccggagtct

SEQ ID NO: 6287 - DNA, 21 bp, Homo sapiens
ttggacggagaactgataagg

SEQ ID NO: 6288 - DNA, 22 bp, Homo sapiens
ttggacggagaactgataaggg

SEQ ID NO: 6289 - DNA, 17 bp, Homo sapiens
tggacggagaactgata

SEQ ID NO: 6290 - DNA, 22 bp, Homo sapiens
ccttatcacttttccagcccag

SEQ ID NO: 6291 - DNA, 19 bp, Homo sapiens
ttgccggccagtcacgtcc

SEQ ID NO: 6292 - DNA, 21 bp, Homo sapiens
cacaactagactgtgagcttc

SEQ ID NO: 6293 - DNA, 23 bp, Homo sapiens
ccttatcacttttccagcccagc

SEQ ID NO: 6294 - DNA, 20 bp, Homo sapiens
aggctgtgagaataactgca

SEQ ID NO: 6295 - DNA, 16 bp, Homo sapiens
tggacggagaactgat

SEQ ID NO: 6296 - DNA, 21 bp, Homo sapiens
aggctgtgagaataactgcaa

SEQ ID NO: 6297 - DNA, 27 bp, Homo sapiens
tgacattttggtatctttcatctgacc

SEQ ID NO: 6298 - DNA, 24 bp, Homo sapiens
actgctagctgtagaactccagct

SEQ ID NO: 6299 - DNA, 22 bp, Homo sapiens
gtgaattaccgaagggccataa

SEQ ID NO: 6300 - DNA, 19 bp, Homo sapiens
taaagtgcttatagtgcag

SEQ ID NO: 6301 - DNA, 21 bp, Homo sapiens
aagattgggtcctagtagtac

SEQ ID NO: 6302 - DNA, 21 bp, Homo sapiens
aaagtgcttacagtgcaggta

SEQ ID NO: 6303 - DNA, 23 bp, Homo sapiens
cgggtggatcacgatgcaatttt

SEQ ID NO: 6304 - DNA, 15 bp, Homo sapiens
aattgcacggtatcc

SEQ ID NO: 6305 - DNA, 20 bp, Homo sapiens
aaagtgcttacagtgcaggt

SEQ ID NO: 6306 - DNA, 22 bp, Homo sapiens
aaatgatctgttttgctgttgt

SEQ ID NO: 6307 - DNA, 22 bp, Homo sapiens
actgcaatgtaagcacttctta

SEQ ID NO: 6308 - DNA, 21 bp, Homo sapiens
aatgatctgttttgctgttgt

SEQ ID NO: 6309 - DNA, 22 bp, Homo sapiens
tactgcaatgtaagcacttctt

SEQ ID NO: 6310 - DNA, 23 bp, Homo sapiens
agtgccgccatcttttgagtgtt

SEQ ID NO: 6311 - DNA, 21 bp, Homo sapiens
caatcatgtgcagtgccaata

SEQ ID NO: 6312 - DNA, 22 bp, Homo sapiens
gcgacccatacttggtttcaga

SEQ ID NO: 6313 - DNA, 19 bp, Homo sapiens
actgtaaacgctttctgat

SEQ ID NO: 6314 - DNA, 17 bp, Homo sapiens
cacttgtcccggcctgt

SEQ ID NO: 6315 - DNA, 21 bp, Homo sapiens
ctcacacagaaatcgcacccg

SEQ ID NO: 6316 - DNA, 21 bp, Homo sapiens
gatgagctcattgtaatatga

SEQ ID NO: 6317 - DNA, 21 bp, Homo sapiens
tttcagtcagatgtttgctgc

SEQ ID NO: 6318 - DNA, 22 bp, Homo sapiens
agcccctgcccaccgcacactg

SEQ ID NO: 6319 - DNA, 20 bp, Homo sapiens
ctaggtatggtcccagggat

SEQ ID NO: 6320 - DNA, 21 bp, Homo sapiens
ttatcagactgatgttgactg

SEQ ID NO: 6321 - DNA, 22 bp, Homo sapiens
atggcaacaccagtcgatgggc

SEQ ID NO: 6322 - DNA, 19 bp, Homo sapiens
tggaagactagtgattttg

SEQ ID NO: 6323 - DNA, 19 bp, Homo sapiens
atactgcatcaggaactga

SEQ ID NO: 6324 - DNA, 22 bp, Homo sapiens
gaggtagtaggttgtatggttt

SEQ ID NO: 6325 - DNA, 15 bp, Homo sapiens
tttccggctcgcgtg

SEQ ID NO: 6326 - DNA, 23 bp, Homo sapiens
tgcggggctagggctaacagcag

SEQ ID NO: 6327 - DNA, 19 bp, Homo sapiens
ggagtgtgacaatggtgtt

SEQ ID NO: 6328 - DNA, 20 bp, Homo sapiens
atgcagtccatgggcatata

SEQ ID NO: 6329 - DNA, 19 bp, Homo sapiens
ccctgtggactcagttctg

SEQ ID NO: 6330 - DNA, 17 bp, Homo sapiens
actgaattccataggct

SEQ ID NO: 6331 - DNA, 18 bp, Homo sapiens
ctgcgcaagctactgcct

SEQ ID NO: 6332 - DNA, 17 bp, Homo sapiens
ctgcgcaagctactgcc

SEQ ID NO: 6333 - DNA, 18 bp, Homo sapiens
ccactgaccgttgactgt

SEQ ID NO: 6334 - DNA, 16 bp, Homo sapiens
ccttctgaacagagcg

SEQ ID NO: 6335 - DNA, 19 bp, Homo sapiens
cccctgggcctatcctaga

SEQ ID NO: 6336 - DNA, 17 bp, Homo sapiens
tgccctgtggactcagt

SEQ ID NO: 6337 - DNA, 16 bp, Homo sapiens
tccctgagacccttta

SEQ ID NO: 6338 - DNA, 18 bp, Homo sapiens
tgccctgtggactcagtt

SEQ ID NO: 6339 - DNA, 19 bp, Homo sapiens
ccttcagaggactccaagg

SEQ ID NO: 6340 - DNA, 17 bp, Homo sapiens
accactgaccgttgact

SEQ ID NO: 6341 - DNA, 23 bp, Homo sapiens
caaatctccggaccacttagtct

SEQ ID NO: 6342 - DNA, 16 bp, Homo sapiens
agactatggaacgtag

SEQ ID NO: 6343 - DNA, 19 bp, Homo sapiens
tgatgggtgaatttgtaga

SEQ ID NO: 6344 - DNA, 18 bp, Homo sapiens
gtagtaagttgtattgtt

SEQ ID NO: 6345 - DNA, 20 bp, Homo sapiens
cacagtgaaccggtctcttt

SEQ ID NO: 6346 - DNA, 22 bp, Homo sapiens
aagaagatctcgtgctgtgacc

SEQ ID NO: 6347 - DNA, 19 bp, Homo sapiens
attgcactcgtcccggcct

SEQ ID NO: 6348 - DNA, 18 bp, Homo sapiens
ttcaccaccttctccacc

SEQ ID NO: 6349 - DNA, 20 bp, Homo sapiens
aagtgcttatagtgcaggta

SEQ ID NO: 6350 - DNA, 17 bp, Homo sapiens
caccagtcgatgggctg

SEQ ID NO: 6351 - DNA, 19 bp, Homo sapiens
agtggatgatgcactctgt

SEQ ID NO: 6352 - DNA, 20 bp, Homo sapiens
agtggatgatgcactctgtg

SEQ ID NO: 6353 - DNA, 19 bp, Homo sapiens
tagtggatgatgcactctg

SEQ ID NO: 6354 - DNA, 17 bp, Homo sapiens
cgggaacgtcgagactg

SEQ ID NO: 6355 - DNA, 18 bp, Homo sapiens
ctcagtagccagtgtaga

SEQ ID NO: 6356 - DNA, 19 bp, Homo sapiens
tgtgcctggcctgaggagc

SEQ ID NO: 6357 - DNA, 21 bp, Homo sapiens
gagtgtgacaatggtgtttgt

SEQ ID NO: 6358 - DNA, 19 bp, Homo sapiens
aattgtggctggacatctg

SEQ ID NO: 6359 - DNA, 17 bp, Homo sapiens
gagaattgtggctggac

SEQ ID NO: 6360 - DNA, 22 bp, Homo sapiens
gcaaagcacacggcctgcagag

SEQ ID NO: 6361 - DNA, 16 bp, Homo sapiens
tgattgtccaaacgca

SEQ ID NO: 6362 - DNA, 18 bp, Homo sapiens
attgtggctggacatctg

SEQ ID NO: 6363 - DNA, 18 bp, Homo sapiens
gcatcagtgattttgttg

SEQ ID NO: 6364 - DNA, 23 bp, Homo sapiens
gcaaagcacacggcctgcagaga

SEQ ID NO: 6365 - DNA, 19 bp, Homo sapiens
attgtggctggacatctgt

SEQ ID NO: 6366 - DNA, 19 bp, Homo sapiens
gaattgtggctggacatct

SEQ ID NO: 6367 - DNA, 22 bp, Homo sapiens
caaagcacacggcctgcagaga

SEQ ID NO: 6368 - DNA, 18 bp, Homo sapiens
agaattgtggctggacat

SEQ ID NO: 6369 - DNA, 19 bp, Homo sapiens
tctctgggcctgtgtctta

SEQ ID NO: 6370 - DNA, 19 bp, Homo sapiens
aacaatatcctggtgctga

SEQ ID NO: 6371 - DNA, 17 bp, Homo sapiens
gtagtaagttgtattgt

SEQ ID NO: 6372 - DNA, 20 bp, Homo sapiens
ctctagatggaagcactgtc

SEQ ID NO: 6373 - DNA, 20 bp, Homo sapiens
gtgtgcggaaatgcttctgc

SEQ ID NO: 6374 - DNA, 24 bp, Homo sapiens
atggttgaccatagaacatgcgct

SEQ ID NO: 6375 - DNA, 25 bp, Homo sapiens
taatccttgctatctgggtgctagt

SEQ ID NO: 6376 - DNA, 23 bp, Homo sapiens
ccacttggatctgaaggctgccc

SEQ ID NO: 6377 - DNA, 22 bp, Homo sapiens
cacttggatctgaaggctgccc

SEQ ID NO: 6378 - DNA, 19 bp, Homo sapiens
gccttgagtgtaggaccgt

SEQ ID NO: 6379 - DNA, 23 bp, Homo sapiens
aagttctgttatacactcaggct

SEQ ID NO: 6380 - DNA, 22 bp, Homo sapiens
gaagttctgttatacactcagg

SEQ ID NO: 6381 - DNA, 20 bp, Homo sapiens
tatcagattgtattgtaatt

SEQ ID NO: 6382 - DNA, 17 bp, Homo sapiens
ctatacgacctgctgcc

SEQ ID NO: 6383 - DNA, 20 bp, Homo sapiens
aaggcacgcggtgaatgcca

SEQ ID NO: 6384 - DNA, 23 bp, Homo sapiens
cagattcgattctaggggaatat

SEQ ID NO: 6385 - DNA, 20 bp, Homo sapiens
ctatacaatctattgccttc

SEQ ID NO: 6386 - DNA, 18 bp, Homo sapiens
gaatcccaaaagcagctg

SEQ ID NO: 6387 - DNA, 17 bp, Homo sapiens
gaatcccaaaagcagct

SEQ ID NO: 6388 - DNA, 21 bp, Homo sapiens
caacaggtgactggttagaca

SEQ ID NO: 6389 - DNA, 20 bp, Homo sapiens
caacaggtgactggttagac

SEQ ID NO: 6390 - DNA, 20 bp, Homo sapiens
tgtttaaccttttgcctgtt

SEQ ID NO: 6391 - DNA, 17 bp, Homo sapiens
aacaggtgactggttag

SEQ ID NO: 6392 - DNA, 17 bp, Homo sapiens
tgattggtacgtctgtg

SEQ ID NO: 6393 - DNA, 21 bp, Homo sapiens
tcactaaccacacggccaggt

SEQ ID NO: 6394 - DNA, 18 bp, Homo sapiens
aggcagtgtagttagctg

SEQ ID NO: 6395 - DNA, 22 bp, Homo sapiens
cataaagctagataaccgaaag

SEQ ID NO: 6396 - DNA, 20 bp, Homo sapiens
agagttgagtctggacgtcc

SEQ ID NO: 6397 - DNA, 20 bp, Homo sapiens
taacagtctccagtcacggc

SEQ ID NO: 6398 - DNA, 19 bp, Homo sapiens
accgtggctttcgattgtt

SEQ ID NO: 6399 - DNA, 18 bp, Homo sapiens
ctgttgccactaacctca

SEQ ID NO: 6400 - DNA, 21 bp, Homo sapiens
aaagctagataaccgaaagta

SEQ ID NO: 6401 - DNA, 19 bp, Homo sapiens
aaagcacacggcctgcaga

SEQ ID NO: 6402 - DNA, 21 bp, Homo sapiens
aactgaaatatttgggactga

SEQ ID NO: 6403 - DNA, 19 bp, Homo sapiens
cagattcgattctagggga

SEQ ID NO: 6404 - DNA, 23 bp, Homo sapiens
ccacagggtagaaccacggacag

SEQ ID NO: 6405 - DNA, 20 bp, Homo sapiens
agattcgattctaggggaat

SEQ ID NO: 6406 - DNA, 27 bp, Homo sapiens
ccctcctgatgattcttcttcctgagc

SEQ ID NO: 6407 - DNA, 23 bp, Homo sapiens
tccatcttccagtacagtgttgg

SEQ ID NO: 6408 - DNA, 25 bp, Homo sapiens
aggaagccctggaggggctggaggt

SEQ ID NO: 6409 - DNA, 23 bp, Homo sapiens
cgtcttacccagcagtgtttggg

SEQ ID NO: 6410 - DNA, 21 bp, Homo sapiens
tacgtagatatatatgtattt

SEQ ID NO: 6411 - DNA, 18 bp, Homo sapiens
cgtcaacacttgctggtt

SEQ ID NO: 6412 - DNA, 21 bp, Homo sapiens
gctcggtctgaggcccctcag

SEQ ID NO: 6413 - DNA, 21 bp, Homo sapiens
agtggggaacccttccatgag

SEQ ID NO: 6414 - DNA, 18 bp, Homo sapiens
atcacattgccagtgatt

SEQ ID NO: 6415 - DNA, 18 bp, Homo sapiens
actgtctggtaaagatgg

SEQ ID NO: 6416 - DNA, 22 bp, Homo sapiens
agaccctggtctgcactctatc

SEQ ID NO: 6417 - DNA, 30 bp, Homo sapiens
ggtgcagtgctgcatctctggtcagttggg

SEQ ID NO: 6418 - DNA, 22 bp, Homo sapiens
aagaagatctcaggttgtgacc

SEQ ID NO: 6419 - DNA, 23 bp, Homo sapiens
caagaagatctcaggttgtgacc

SEQ ID NO: 6420 - DNA, 16 bp, Homo sapiens
ccctgtagatccgaat

SEQ ID NO: 6421 - DNA, 20 bp, Homo sapiens
ctttcagtcggatgtttaca

SEQ ID NO: 6422 - DNA, 22 bp, Homo sapiens
gcaatggtagaactcacactgg

SEQ ID NO: 6423 - DNA, 18 bp, Homo sapiens
gctgactcctagtccagg

SEQ ID NO: 6424 - DNA, 21 bp, Homo sapiens
acattcattgttgtcggtggg

SEQ ID NO: 6425 - DNA, 19 bp, Homo sapiens
aacggaatcccaaaagcag

SEQ ID NO: 6426 - DNA, 19 bp, Homo sapiens
gatcagaaggtgattgtgg

SEQ ID NO: 6427 - DNA, 18 bp, Homo sapiens
tgacacgatcactcccgt

SEQ ID NO: 6428 - DNA, 20 bp, Homo sapiens
ctcggtctgaggcccctcag

SEQ ID NO: 6429 - DNA, 27 bp, Homo sapiens
taatccttgctacctgggtgagagtgc

SEQ ID NO: 6430 - DNA, 19 bp, Homo sapiens
ggaggaaagaagggagtgg

SEQ ID NO: 6431 - DNA, 24 bp, Homo sapiens
tgggtttacgttgggagaactttt

SEQ ID NO: 6432 - DNA, 26 bp, Homo sapiens
aatccttgctatctgggtgctagtgc

SEQ ID NO: 6433 - DNA, 19 bp, Homo sapiens
ccgacaccatggccctggc

SEQ ID NO: 6434 - DNA, 20 bp, Homo sapiens
gctgcgcttggatttcgtcc

SEQ ID NO: 6435 - DNA, 22 bp, Homo sapiens
gtcggccgcgctcgaggggtcc

SEQ ID NO: 6436 - DNA, 20 bp, Homo sapiens
cccgacaccatggccctggc

SEQ ID NO: 6437 - DNA, 20 bp, Homo sapiens
atattgcactcgtcccggcc

SEQ ID NO: 6438 - DNA, 22 bp, Homo sapiens
tgaattaccgaagggccataaa

SEQ ID NO: 6439 - DNA, 20 bp, Homo sapiens
tgaattaccgaagggccata

SEQ ID NO: 6440 - DNA, 21 bp, Homo sapiens
catctggaggtaagaagcact

SEQ ID NO: 6441 - DNA, 19 bp, Homo sapiens
caagtgcttccttttagag

SEQ ID NO: 6442 - DNA, 20 bp, Homo sapiens
tctacaaaggaaagcgcttt

SEQ ID NO: 6443 - DNA, 19 bp, Homo sapiens
gtatggcactggtagaatt

SEQ ID NO: 6444 - DNA, 20 bp, Homo sapiens
gaacgcgcttccctatagag

SEQ ID NO: 6445 - DNA, 18 bp, Homo sapiens
atctggaggtaagaagca

SEQ ID NO: 6446 - DNA, 22 bp, Homo sapiens
ccatctggaggtaagaagcact

SEQ ID NO: 6447 - DNA, 19 bp, Homo sapiens
actcagccttgagggcact

SEQ ID NO: 6448 - DNA, 20 bp, Homo sapiens
tttggcactagcacattttt

SEQ ID NO: 6449 - DNA, 20 bp, Homo sapiens
gaaagcgcttcccttcagag

SEQ ID NO: 6450 - DNA, 19 bp, Homo sapiens
ctacaaagggaagcacttt

SEQ ID NO: 6451 - DNA, 19 bp, Homo sapiens
aaagtgcatccttttagag

SEQ ID NO: 6452 - DNA, 19 bp, Homo sapiens
ctacaaaggaaagcgcttt

SEQ ID NO: 6453 - DNA, 19 bp, Homo sapiens
aaagtgcttctctttggtg

SEQ ID NO: 6454 - DNA, 20 bp, Homo sapiens
ttctccaaaagaaagcactt

SEQ ID NO: 6455 - DNA, 19 bp, Homo sapiens
tttcaagccagggggcgtt

SEQ ID NO: 6456 - DNA, 23 bp, Homo sapiens
atgttgactgttgaatctcatgg

SEQ ID NO: 6457 - DNA, 20 bp, Homo sapiens
tctcccacgttgtggcccag

SEQ ID NO: 6458 - DNA, 18 bp, Homo sapiens
gcttttcattcctatgtg

SEQ ID NO: 6459 - DNA, 20 bp, Homo sapiens
gtgcctgagggagtaagagc

SEQ ID NO: 6460 - DNA, 20 bp, Homo sapiens
caccttgcgctactcaggtc

SEQ ID NO: 6461 - DNA, 19 bp, Homo sapiens
agtgcctgagggagtaaga

SEQ ID NO: 6462 - DNA, 20 bp, Homo sapiens
tggtagaattcactgtgaac

SEQ ID NO: 6463 - DNA, 22 bp, Homo sapiens
tctttacagtgctgccttgtag

SEQ ID NO: 6464 - DNA, 18 bp, Homo sapiens
ttgcagctgcctgggagt

SEQ ID NO: 6465 - DNA, 15 bp, Homo sapiens
caaagtgctgttcgt

SEQ ID NO: 6466 - DNA, 17 bp, Homo sapiens
gtagaaccgaatttgtg

SEQ ID NO: 6467 - DNA, 20 bp, Homo sapiens
caggtgaggttcttgggagc

SEQ ID NO: 6468 - DNA, 20 bp, Homo sapiens
cggggttttgagggcgagat

SEQ ID NO: 6469 - DNA, 23 bp, Homo sapiens
tctgctcataccccatggtttct

SEQ ID NO: 6470 - DNA, 19 bp, Homo sapiens
ggggttcctggggatggga

SEQ ID NO: 6471 - DNA, 19 bp, Homo sapiens
tcgctcagctgatctgtgg

SEQ ID NO: 6472 - DNA, 19 bp, Homo sapiens
cagtgcctcggcagtgcag

SEQ ID NO: 6473 - DNA, 19 bp, Homo sapiens
agggcttagctgcttgtga

SEQ ID NO: 6474 - DNA, 21 bp, Homo sapiens
ccagtattaactgtgctgctg

SEQ ID NO: 6475 - DNA, 21 bp, Homo sapiens
gctatgccaacatattgccat

SEQ ID NO: 6476 - DNA, 18 bp, Homo sapiens
gatttcagtggagtgaag

SEQ ID NO: 6477 - DNA, 20 bp, Homo sapiens
gctatgccaacatattgcca

SEQ ID NO: 6478 - DNA, 23 bp, Homo sapiens
gcaagaggatctcaggctgtgac

SEQ ID NO: 6479 - DNA, 23 bp, Homo sapiens
caagaagatctcaggctgtgacc

SEQ ID NO: 6480 - DNA, 23 bp, Homo sapiens
caagaagatctcaagctgtgact

SEQ ID NO: 6481 - DNA, 22 bp, Homo sapiens
aagaagatctcaagctgtgagt

SEQ ID NO: 6482 - DNA, 22 bp, Homo sapiens
aagaatatctcaggctgtgacc

SEQ ID NO: 6483 - DNA, 22 bp, Homo sapiens
aaacgtggatgtacttgctttg

SEQ ID NO: 6484 - DNA, 22 bp, Homo sapiens
aagaagatgtcaggctgtgacc

SEQ ID NO: 6485 - DNA, 25 bp, Homo sapiens
tggagcaagatctcaggctgtgacc

SEQ ID NO: 6486 - DNA, 23 bp, Homo sapiens
caagaagatctcaggctgtgtcc

SEQ ID NO: 6487 - DNA, 21 bp, Homo sapiens
tctcgaggaaagaagcacttt

SEQ ID NO: 6488 - DNA, 22 bp, Homo sapiens
tctcgaggaaagaagcactttc

SEQ ID NO: 6489 - DNA, 20 bp, Homo sapiens
gagtctccagtaatggacgg

SEQ ID NO: 6490 - DNA, 21 bp, Homo sapiens
agagtctccagtaatggacgg

SEQ ID NO: 6491 - DNA, 20 bp, Homo sapiens
tgtctactactggagacact

SEQ ID NO: 6492 - DNA, 20 bp, Homo sapiens
ctctttccctgttgcactac

SEQ ID NO: 6493 - DNA, 18 bp, Homo sapiens
ttaaggcacgcggtgaat

SEQ ID NO: 6494 - DNA, 17 bp, Homo sapiens
aagctcggtctgaggcc

SEQ ID NO: 6495 - DNA, 16 bp, Homo sapiens
aagctcggtctgaggc

SEQ ID NO: 6496 - DNA, 16 bp, Homo sapiens
agctcggtctgaggcc

SEQ ID NO: 6497 - DNA, 22 bp, Homo sapiens
actccagttttagttctcttgc

SEQ ID NO: 6498 - DNA, 21 bp, Homo sapiens
aacatcacagcaagtctgtgc

SEQ ID NO: 6499 - DNA, 23 bp, Homo sapiens
tttggtccccttcaaccagctac

SEQ ID NO: 6500 - DNA, 23 bp, Homo sapiens
ttaagacttgcagtgatgtttaa

SEQ ID NO: 6501 - DNA, 24 bp, Homo sapiens
taatccttgctatctgggtgctag

SEQ ID NO: 6502 - DNA, 22 bp, Homo sapiens
cttcaccaccttctccacccag

SEQ ID NO: 6503 - DNA, 22 bp, Homo sapiens
tcagtagccagtgtagatcctg

SEQ ID NO: 6504 - DNA, 15 bp, Homo sapiens
gtgagtaataatgcg

SEQ ID NO: 6505 - DNA, 22 bp, Homo sapiens
accacagggtagaaccacggac

SEQ ID NO: 6506 - DNA, 21 bp, Homo sapiens
ctaacactgtctggtaaagat

SEQ ID NO: 6507 - DNA, 19 bp, Homo sapiens
taatactgtctggtaaaac

SEQ ID NO: 6508 - DNA, 22 bp, Homo sapiens
caaagtttaagatccttgaagt

SEQ ID NO: 6509 - DNA, 22 bp, Homo sapiens
catcaaggatcttaaactttgc

SEQ ID NO: 6510 - DNA, 25 bp, Homo sapiens
ctaggtatggtcccagggatcccag

SEQ ID NO: 6511 - DNA, 16 bp, Homo sapiens
cgttcggctcgcgtga

SEQ ID NO: 6512 - DNA, 18 bp, Homo sapiens
gtaaacatccccgactgg

SEQ ID NO: 6513 - DNA, 20 bp, Homo sapiens
gtaaacatccccgactggaa

SEQ ID NO: 6514 - DNA, 22 bp, Homo sapiens
gaacgcgcttccctatagaggg

SEQ ID NO: 6515 - DNA, 19 bp, Homo sapiens
gaaagcgcttccctttgct

SEQ ID NO: 6516 - DNA, 22 bp, Homo sapiens
acctatgaattgacagccagtg

SEQ ID NO: 6517 - DNA, 22 bp, Homo sapiens
gtgcaaatctatgcaaaactga

SEQ ID NO: 6518 - DNA, 24 bp, Homo sapiens
tttacgttgggagaacttttacgg

SEQ ID NO: 6519 - DNA, 26 bp, Homo sapiens
ttatggtttgcctgggactgaggaat

SEQ ID NO: 6520 - DNA, 21 bp, Homo sapiens
tcagttccaggccaaccaggc

SEQ ID NO: 6521 - DNA, 19 bp, Homo sapiens
gcaggcacagacaggcagt

SEQ ID NO: 6522 - DNA, 27 bp, Homo sapiens
gtcgggaaaagctgggttgagagggcg

SEQ ID NO: 6523 - DNA, 24 bp, Homo sapiens
tgatatgtttgatatattaggttg

SEQ ID NO: 6524 - DNA, 20 bp, Homo sapiens
tcaaatgctcagactcctgt

SEQ ID NO: 6525 - DNA, 23 bp, Homo sapiens
tgttgtcggtgggttgtgaggac

SEQ ID NO: 6526 - DNA, 23 bp, Homo sapiens
ggcaatggtagaactcacactgg

SEQ ID NO: 6527 - DNA, 20 bp, Homo sapiens
tcactaaccacacggccagg

SEQ ID NO: 6528 - DNA, 23 bp, Homo sapiens
tgagcaccacacaggccgggcgc

SEQ ID NO: 6529 - DNA, 17 bp, Homo sapiens
gctgggttgagagggcg

SEQ ID NO: 6530 - DNA, 26 bp, Homo sapiens
tatcagactgatgttgactgttgaat

SEQ ID NO: 6531 - DNA, 28 bp, Homo sapiens
cttatcagactgatgttgactgttgaat

SEQ ID NO: 6532 - DNA, 27 bp, Homo sapiens
tatcagactgatgttgactgttgaatc

SEQ ID NO: 6533 - DNA, 26 bp, Homo sapiens
agatgggctttcagtcggatgtttgc

SEQ ID NO: 6534 - DNA, 25 bp, Homo sapiens
catggcaacaccagtcgatgggctg

SEQ ID NO: 6535 - DNA, 26 bp, Homo sapiens
tgggctttcagtcggatgtttgcagc

SEQ ID NO: 6536 - DNA, 30 bp, Homo sapiens
tctcatggcaacaccagtcgatgggctgtc

SEQ ID NO: 6537 - DNA, 29 bp, Homo sapiens
cttatcagactgatgttgactgttgaatc

SEQ ID NO: 6538 - DNA, 17 bp, Homo sapiens
ccatttgaaatcggtta

SEQ ID NO: 6539 - DNA, 22 bp, Homo sapiens
taccctgtagaaccgaatttgt

SEQ ID NO: 6540 - DNA, 20 bp, Homo sapiens
aaacatccccgactggaagc

SEQ ID NO: 6541 - DNA, 19 bp, Homo sapiens
cagcaattcatgttttgaa

SEQ ID NO: 6542 - DNA, 21 bp, Homo sapiens
ctgtaacagcaactccatgtg

SEQ ID NO: 6543 - DNA, 20 bp, Homo sapiens
cagtgtagttagctgattgc

SEQ ID NO: 6544 - DNA, 19 bp, Homo sapiens
ccactgccccaggtgctgc

SEQ ID NO: 6545 - DNA, 20 bp, Homo sapiens
tcactaactccactgccatc

SEQ ID NO: 6546 - DNA, 24 bp, Homo sapiens
taacactgtctggtaacgatgttc

SEQ ID NO: 6547 - DNA, 20 bp, Homo sapiens
aagctagataaccgaaagta

SEQ ID NO: 6548 - DNA, 21 bp, Homo sapiens
tggtagaattcactgtgaaca

SEQ ID NO: 6549 - DNA, 21 bp, Homo sapiens
ttttcccaggaatcccttaga

SEQ ID NO: 6550 - DNA, 23 bp, Homo sapiens
gtctgagatgaagcactgtagct

SEQ ID NO: 6551 - DNA, 19 bp, Homo sapiens
ctgtctacacttgctgtgc

SEQ ID NO: 6552 - DNA, 23 bp, Homo sapiens
aagcagcattgtacagggctatg

SEQ ID NO: 6553 - DNA, 23 bp, Homo sapiens
cgctagcgtgtggtacttgaaga

SEQ ID NO: 6554 - DNA, 21 bp, Homo sapiens
tcagccttcggtacttgaaga

SEQ ID NO: 6555 - DNA, 22 bp, Homo sapiens
gctgacgtgcggtacttaatga

SEQ ID NO: 6556 - DNA, 21 bp, Homo sapiens
ctataaccatgctgtagtgtg

SEQ ID NO: 6557 - DNA, 21 bp, Homo sapiens
aaattattgtacatcggatga

SEQ ID NO: 6558 - DNA, 20 bp, Homo sapiens
cccagataatggcactctca

SEQ ID NO: 6559 - DNA, 19 bp, Homo sapiens
tgcaatgttaaaagggcat

SEQ ID NO: 6560 - DNA, 25 bp, Homo sapiens
atgcaccatggttgtctgagcatgc

SEQ ID NO: 6561 - DNA, 21 bp, Homo sapiens
ctggctagggaaaatgattgg

SEQ ID NO: 6562 - DNA, 22 bp, Homo sapiens
aaaagctgggttgagagggtaa

SEQ ID NO: 6563 - DNA, 19 bp, Homo sapiens
acagtatagatgatgtact

SEQ ID NO: 6564 - DNA, 17 bp, Homo sapiens
cagtatagatgatgtac

SEQ ID NO: 6565 - DNA, 25 bp, Homo sapiens
gaaaatgatgagtagtgactgatga

SEQ ID NO: 6566 - DNA, 25 bp, Homo sapiens
tgaaaatgatgagtagtgactgatg

SEQ ID NO: 6567 - DNA, 21 bp, Homo sapiens
actgacaggagagcattttga

SEQ ID NO: 6568 - DNA, 21 bp, Homo sapiens
gggttcctggcatgctgattt

SEQ ID NO: 6569 - DNA, 19 bp, Homo sapiens
taatgcccctaaaaatcct

SEQ ID NO: 6570 - DNA, 18 bp, Homo sapiens
gcactcgtcccggcctcc

SEQ ID NO: 6571 - DNA, 22 bp, Homo sapiens
gagtgtgacaatggtgtttgtg

SEQ ID NO: 6572 - DNA, 20 bp, Homo sapiens
tggcttttcattcctatgtg

SEQ ID NO: 6573 - DNA, 19 bp, Homo sapiens
cagccacaactaccctgcc

SEQ ID NO: 6574 - DNA, 21 bp, Homo sapiens
caggcacgggagctcaggtga

SEQ ID NO: 6575 - DNA, 20 bp, Homo sapiens
tgcagctgcctgggagtgac

SEQ ID NO: 6576 - DNA, 24 bp, Homo sapiens
tggtagactatggaacgtaggcgt

SEQ ID NO: 6577 - DNA, 22 bp, Homo sapiens
cgagggcatttcatgatgcagg

SEQ ID NO: 6578 - DNA, 18 bp, Homo sapiens
gaggtagtaggttgtgtg

SEQ ID NO: 6579 - DNA, 20 bp, Homo sapiens
gtcttaccagacatggttag

SEQ ID NO: 6580 - DNA, 22 bp, Homo sapiens
tccccttctgcaggcctgctgg

SEQ ID NO: 6581 - DNA, 21 bp, Homo sapiens
ccagtcctgtgcctgccgcct

SEQ ID NO: 6582 - DNA, 19 bp, Homo sapiens
tgtccttgctgtttggaga

SEQ ID NO: 6583 - DNA, 18 bp, Homo sapiens
tgtccttgctgtttggag

SEQ ID NO: 6584 - DNA, 22 bp, Homo sapiens
ttgtccttgctgtttggagata

SEQ ID NO: 6585 - DNA, 21 bp, Homo sapiens
ttgtccttgctgtttggagat

SEQ ID NO: 6586 - DNA, 21 bp, Homo sapiens
attgtccttgctgtttggaga

SEQ ID NO: 6587 - DNA, 23 bp, Homo sapiens
attgtccttgctgtttggagata

SEQ ID NO: 6588 - DNA, 20 bp, Homo sapiens
ccagtcctgtgcctgccgcc

SEQ ID NO: 6589 - DNA, 19 bp, Homo sapiens
gtcaggcggctcggactga

SEQ ID NO: 6590 - DNA, 21 bp, Homo sapiens
catccgcgctctgactctctg

SEQ ID NO: 6591 - DNA, 22 bp, Homo sapiens
ccatccgcgctctgactctctg

SEQ ID NO: 6592 - DNA, 21 bp, Homo sapiens
ttcgtgcgacgtgtggcgtgg

SEQ ID NO: 6593 - DNA, 23 bp, Homo sapiens
aaggcagggcccccgctccccgg

SEQ ID NO: 6594 - DNA, 22 bp, Homo sapiens
catcagggcttgtggaatggga

SEQ ID NO: 6595 - DNA, 21 bp, Homo sapiens
tccgcgctctgactctctgcc

SEQ ID NO: 6596 - DNA, 20 bp, Homo sapiens
tccgcgctctgactctctgc

SEQ ID NO: 6597 - DNA, 21 bp, Homo sapiens
catggccgaaacagagaagtt

SEQ ID NO: 6598 - DNA, 21 bp, Homo sapiens
gtccctctccaaatgtgtctt

SEQ ID NO: 6599 - DNA, 18 bp, Homo sapiens
aacgccattatcacacta

SEQ ID NO: 6600 - DNA, 19 bp, Homo sapiens
ccagtggggctgctgttat

SEQ ID NO: 6601 - DNA, 19 bp, Homo sapiens
tggtacgtctgtgggtaga

SEQ ID NO: 6602 - DNA, 20 bp, Homo sapiens
agcagcacactgtggtttgt

SEQ ID NO: 6603 - DNA, 22 bp, Homo sapiens
acattcaacctgtcggtgagtt

SEQ ID NO: 6604 - DNA, 16 bp, Homo sapiens
ggtcgctggtacatga

SEQ ID NO: 6605 - DNA, 18 bp, Homo sapiens
aactggcctacaaagtcc

SEQ ID NO: 6606 - DNA, 16 bp, Homo sapiens
atcctcgactggaagc

SEQ ID NO: 6607 - DNA, 24 bp, Homo sapiens
ctgtgcgtgtgacagcggctgatc

SEQ ID NO: 6608 - DNA, 18 bp, Homo sapiens
agtgtattgttagctggt

SEQ ID NO: 6609 - DNA, 22 bp, Homo sapiens
ggcagtgtagttagctgattgc

SEQ ID NO: 6610 - DNA, 21 bp, Homo sapiens
ggcagtgtagttagctgattg

SEQ ID NO: 6611 - DNA, 20 bp, Homo sapiens
agtgcactacagaactttgt

SEQ ID NO: 6612 - DNA, 19 bp, Homo sapiens
aagttctgagacactccga

SEQ ID NO: 6613 - DNA, 22 bp, Homo sapiens
caccgcggtcttttcctcccac

SEQ ID NO: 6614 - DNA, 16 bp, Homo sapiens
acaatctctactgaac

SEQ ID NO: 6615 - DNA, 18 bp, Homo sapiens
cagaactggtcggtgatt

SEQ ID NO: 6616 - DNA, 22 bp, Homo sapiens
cagcactagattgtaaagactg

SEQ ID NO: 6617 - DNA, 15 bp, Homo sapiens
atcctcgactggaag

SEQ ID NO: 6618 - DNA, 21 bp, Homo sapiens
atattgcacattactaagttg

SEQ ID NO: 6619 - DNA, 18 bp, Homo sapiens
aggcaagatgctggcata

SEQ ID NO: 6620 - DNA, 19 bp, Homo sapiens
ctatacaacctactgcctt

SEQ ID NO: 6621 - DNA, 22 bp, Homo sapiens
ggtcggccgccccgggtgccgc

SEQ ID NO: 6622 - DNA, 19 bp, Homo sapiens
tagtcccttccttgaagcg

SEQ ID NO: 6623 - DNA, 21 bp, Homo sapiens
gtgaattaccgaagggccata

SEQ ID NO: 6624 - DNA, 15 bp, Homo sapiens
tcgaggactggtgga

SEQ ID NO: 6625 - DNA, 16 bp, Homo sapiens
tcgaggactggtggaa

SEQ ID NO: 6626 - DNA, 18 bp, Homo sapiens
caccgccggccgatgggc

SEQ ID NO: 6627 - DNA, 22 bp, Homo sapiens
gctcccacttccagatctttct

SEQ ID NO: 6628 - DNA, 22 bp, Homo sapiens
ttccagatctttctctctgtat

SEQ ID NO: 6629 - DNA, 23 bp, Homo sapiens
ctcccacttccagatctttctct

SEQ ID NO: 6630 - DNA, 23 bp, Homo sapiens
cacttccagatctttctctctgt

SEQ ID NO: 6631 - DNA, 23 bp, Homo sapiens
ttccagatctttctctctgtata

SEQ ID NO: 6632 - DNA, 22 bp, Homo sapiens
acttccagatctttctctctgt

SEQ ID NO: 6633 - DNA, 22 bp, Homo sapiens
cacttccagatctttctctctg

SEQ ID NO: 6634 - DNA, 17 bp, Homo sapiens
tgacctatgaattgaca

SEQ ID NO: 6635 - DNA, 22 bp, Homo sapiens
aaagatctggaagtgggagaca

SEQ ID NO: 6636 - DNA, 21 bp, Homo sapiens
tggctcccacttccagatctt

SEQ ID NO: 6637 - DNA, 23 bp, Homo sapiens
aagatctggaagtgggagacact

SEQ ID NO: 6638 - DNA, 21 bp, Homo sapiens
gctcccacttccagatctttc

SEQ ID NO: 6639 - DNA, 20 bp, Homo sapiens
gctcccacttccagatcttt

SEQ ID NO: 6640 - DNA, 22 bp, Homo sapiens
aagatctggaagtgggagacac

SEQ ID NO: 6641 - DNA, 20 bp, Homo sapiens
aagatctggaagtgggagac

SEQ ID NO: 6642 - DNA, 21 bp, Homo sapiens
ggctcccacttccagatcttt

SEQ ID NO: 6643 - DNA, 21 bp, Homo sapiens
aagatctggaagtgggagaca

SEQ ID NO: 6644 - DNA, 21 bp, Homo sapiens
gaaagatctggaagtgggaga

SEQ ID NO: 6645 - DNA, 22 bp, Homo sapiens
tggctcccacttccagatcttt

SEQ ID NO: 6646 - DNA, 22 bp, Homo sapiens
ggctcccacttccagatctttc

SEQ ID NO: 6647 - DNA, 19 bp, Homo sapiens
aagatctggaagtgggaga

SEQ ID NO: 6648 - DNA, 21 bp, Homo sapiens
agctttcagtcggatgtttac

SEQ ID NO: 6649 - DNA, 19 bp, Homo sapiens
gctggtttcatatggtggt

SEQ ID NO: 6650 - DNA, 19 bp, Homo sapiens
gctggtttcacatggtggc

SEQ ID NO: 6651 - DNA, 18 bp, Homo sapiens
ggggttcctggggatggg

SEQ ID NO: 6652 - DNA, 19 bp, Homo sapiens
tcaggctcagtcccctccc

SEQ ID NO: 6653 - DNA, 20 bp, Homo sapiens
ctggctcagttcagcaggaa

SEQ ID NO: 6654 - DNA, 19 bp, Homo sapiens
gggactggccagtgttgag

SEQ ID NO: 6655 - DNA, 23 bp, Homo sapiens
tgtaaacatccccgactggaagc

SEQ ID NO: 6656 - DNA, 24 bp, Homo sapiens
tgtaaacatccccgactggaagct

SEQ ID NO: 6657 - DNA, 22 bp, Homo sapiens
tagcaccatctgaaatcggtta

SEQ ID NO: 6658 - DNA, 21 bp, Homo sapiens
tagcaccatctgaaatcggtt

SEQ ID NO: 6659 - DNA, 23 bp, Homo sapiens
tgaggtagtaggttgtgtggttt

SEQ ID NO: 6660 - DNA, 22 bp, Homo sapiens
tgaggtagtagattgtatagtt

SEQ ID NO: 6661 - DNA, 20 bp, Homo sapiens
tgaggtagtaggttgtgtgg

SEQ ID NO: 6662 - DNA, 21 bp, Homo sapiens
tgaggtagtaggttgtgtggt

SEQ ID NO: 6663 - DNA, 22 bp, Homo sapiens
tagcttatcagactgatgttga

SEQ ID NO: 6664 - DNA, 22 bp, Homo sapiens
atcacattgccagggatttcca

SEQ ID NO: 6665 - DNA, 23 bp, Homo sapiens
agcagcattgtacagggctatga

SEQ ID NO: 6666 - DNA, 22 bp, Homo sapiens
catgccttgagtgtaggaccgt

SEQ ID NO: 6667 - DNA, 22 bp, Homo sapiens
tattgcacttgtcccggcctgt

SEQ ID NO: 6668 - DNA, 22 bp, Homo sapiens
ttcaagtaatccaggataggct

SEQ ID NO: 6669 - DNA, 23 bp, Homo sapiens
tgaggtagtaggttgtatagttt

SEQ ID NO: 6670 - DNA, 20 bp, Homo sapiens
tgagatgaagcactgtagct

SEQ ID NO: 6671 - DNA, 22 bp, Homo sapiens
aacattcaacgctgtcggtgag

SEQ ID NO: 6672 - DNA, 20 bp, Homo sapiens
tgaggtagtaggttgtatag

SEQ ID NO: 6673 - DNA, 22 bp, Homo sapiens
agcagcattgtacagggctatg

SEQ ID NO: 6674 - DNA, 22 bp, Homo sapiens
cactagattgtgagctcctgga

SEQ ID NO: 6675 - DNA, 22 bp, Homo sapiens
tgtaaacatccccgactggaag

SEQ ID NO: 6676 - DNA, 22 bp, Homo sapiens
tgaggtagtaggttgtgtggtt

SEQ ID NO: 6677 - DNA, 21 bp, Homo sapiens
tgaggtagtaggttgtatagt

SEQ ID NO: 6678 - DNA, 22 bp, Homo sapiens
ctcggcgtggcgtcggtcgtgg

SEQ ID NO: 6679 - DNA, 22 bp, Homo sapiens
tgaggtagtaggttgtatagtt

SEQ ID NO: 6680 - DNA, 23 bp, Homo sapiens
caacggaatcccaaaagcagctg

SEQ ID NO: 6681 - DNA, 21 bp, Homo sapiens
ccgcactgtgggtacttgctg

SEQ ID NO: 6682 - DNA, 22 bp, Homo sapiens
tggctcagttcagcaggaacag

SEQ ID NO: 6683 - DNA, 21 bp, Homo sapiens
cactagattgtgagctcctgg

SEQ ID NO: 6684 - DNA, 22 bp, Homo sapiens
tgaggtaggaggttgtatagtt

SEQ ID NO: 6685 - DNA, 21 bp, Homo sapiens
tagcttatcagactgatgttg

SEQ ID NO: 6686 - DNA, 22 bp, Homo sapiens
cattgcacttgtctcggtctga

SEQ ID NO: 6687 - DNA, 23 bp, Homo sapiens
tagcttatcagactgatgttgac

SEQ ID NO: 6688 - DNA, 22 bp, Homo sapiens
ttcaccaccttctccacccagc

SEQ ID NO: 6689 - DNA, 21 bp, Homo sapiens
cacccgtagaaccgaccttgc

SEQ ID NO: 6690 - DNA, 22 bp, Homo sapiens
caacggaatcccaaaagcagct

SEQ ID NO: 6691 - DNA, 23 bp, Homo sapiens
actcggcgtggcgtcggtcgtgg

SEQ ID NO: 6692 - DNA, 22 bp, Homo sapiens
ctagcaccatctgaaatcggtt

SEQ ID NO: 6693 - DNA, 22 bp, Homo sapiens
tcagtgcactacagaactttgt

SEQ ID NO: 6694 - DNA, 21 bp, Homo sapiens
atcacattgccagggatttcc

SEQ ID NO: 6695 - DNA, 23 bp, Homo sapiens
aacattcaacgctgtcggtgagt

SEQ ID NO: 6696 - DNA, 22 bp, Homo sapiens
tttggcaatggtagaactcaca

SEQ ID NO: 6697 - DNA, 22 bp, Homo sapiens
ctttcagtcggatgtttacagc

SEQ ID NO: 6698 - DNA, 21 bp, Homo sapiens
ctttcagtcggatgtttacag

SEQ ID NO: 6699 - DNA, 23 bp, Homo sapiens
caaagtgctgttcgtgcaggtag

SEQ ID NO: 6700 - DNA, 21 bp, Homo sapiens
cattgcacttgtctcggtctg

SEQ ID NO: 6701 - DNA, 22 bp, Homo sapiens
aagctgccagttgaagaactgt

SEQ ID NO: 6702 - DNA, 22 bp, Homo sapiens
cacccgtagaaccgaccttgcg

SEQ ID NO: 6703 - DNA, 22 bp, Homo sapiens
ctatacgacctgctgcctttct

SEQ ID NO: 6704 - DNA, 23 bp, Homo sapiens
tattgcacttgtcccggcctgtt

SEQ ID NO: 6705 - DNA, 23 bp, Homo sapiens
acattcaacctgtcggtgagttt

SEQ ID NO: 6706 - DNA, 24 bp, Homo sapiens
gtccctgagtgtatgtggtgaacc

SEQ ID NO: 6707 - DNA, 20 bp, Homo sapiens
cgctcatgcacacacccaca

SEQ ID NO: 6708 - DNA, 23 bp, Homo sapiens
gaagctcagagggctctgattca

SEQ ID NO: 6709 - DNA, 20 bp, Homo sapiens
cgtccccttccccgccggcc

SEQ ID NO: 6710 - DNA, 25 bp, Homo sapiens
agatcgaccgtgttatattcgcttt

SEQ ID NO: 6711 - DNA, 18 bp, Homo sapiens
ctcccaacccttgtacca

SEQ ID NO: 6712 - DNA, 21 bp, Homo sapiens
ttgtatgctagctcaggtaga

SEQ ID NO: 6713 - DNA, 23 bp, Homo sapiens
aaacccgtagatccgaacttgtg

SEQ ID NO: 6714 - DNA, 24 bp, Homo sapiens
aaagtgctgcgacatttgagcgtc

SEQ ID NO: 6715 - DNA, 24 bp, Homo sapiens
gcaagaagatctcaggctgtgacc

SEQ ID NO: 6716 - DNA, 19 bp, Homo sapiens
tgtcggccggccctgggtc

SEQ ID NO: 6717 - DNA, 21 bp, Homo sapiens
atcatacacggttgacctatt

SEQ ID NO: 6718 - DNA, 17 bp, Homo sapiens
tcgaggactggtggaag

SEQ ID NO: 6719 - DNA, 22 bp, Homo sapiens
attgtagccttttggagtagag

SEQ ID NO: 6720 - DNA, 22 bp, Homo sapiens
aaaactccttcaagatcgccgg

SEQ ID NO: 6721 - DNA, 19 bp, Homo sapiens
agctagataaccgaaagta

SEQ ID NO: 6722 - DNA, 20 bp, Homo sapiens
ttcctgctgaactgagccag

SEQ ID NO: 6723 - DNA, 19 bp, Homo sapiens
agagcttagctgattggtg

SEQ ID NO: 6724 - DNA, 25 bp, Homo sapiens
ccgtgctgatgtttgacccttgagc

SEQ ID NO: 6725 - DNA, 18 bp, Homo sapiens
tacctgtgtgtgatgagc

SEQ ID NO: 6726 - DNA, 23 bp, Homo sapiens
attatggtttgcctgggactgag

SEQ ID NO: 6727 - DNA, 24 bp, Homo sapiens
tcaagagcaataacgaaaaatgtt

SEQ ID NO: 6728 - DNA, 23 bp, Homo sapiens
aacatagaggaaattccacgttt

SEQ ID NO: 6729 - DNA, 20 bp, Homo sapiens
gtttgataagctgacatggg

SEQ ID NO: 6730 - DNA, 19 bp, Homo sapiens
tttgataagctgacatggg

SEQ ID NO: 6731 - DNA, 17 bp, Homo sapiens
tctcccaacccttgtac

SEQ ID NO: 6732 - DNA, 19 bp, Homo sapiens
catcatcgtctcaaatgag

SEQ ID NO: 6733 - DNA, 30 bp, Homo sapiens
gcggtcggccgcgctcgaggggtccccgtg

SEQ ID NO: 6734 - DNA, 16 bp, Homo sapiens
acttgtctcggtctga

SEQ ID NO: 6735 - DNA, 19 bp, Homo sapiens
aatcactaactccactgcc

SEQ ID NO: 6736 - DNA, 22 bp, Homo sapiens
agggacttttgggggcagatgt

SEQ ID NO: 6737 - DNA, 21 bp, Homo sapiens
agggacttttgggggcagatg

SEQ ID NO: 6738 - DNA, 22 bp, Homo sapiens
tgggaacgggttccggcagacg

SEQ ID NO: 6739 - DNA, 24 bp, Homo sapiens
actcaaaacccttcagtgacttcc

SEQ ID NO: 6740 - DNA, 23 bp, Homo sapiens
cagcccggatcccagcccactta

SEQ ID NO: 6741 - DNA, 19 bp, Homo sapiens
ctgtgcctggcctgaggag

SEQ ID NO: 6742 - DNA, 23 bp, Homo sapiens
agtcccccaggtgtgattctgat

SEQ ID NO: 6743 - DNA, 18 bp, Homo sapiens
tgcggggctagggctaac

SEQ ID NO: 6744 - DNA, 20 bp, Homo sapiens
gttgtgtcagtttatcaaac

SEQ ID NO: 6745 - DNA, 19 bp, Homo sapiens
gtgacagagccacccaggg

SEQ ID NO: 6746 - DNA, 19 bp, Homo sapiens
cgtccccttccccgccggc

SEQ ID NO: 6747 - DNA, 20 bp, Homo sapiens
tcggggatcatcatgtcacg

SEQ ID NO: 6748 - DNA, 22 bp, Homo sapiens
tcggggatcatcatgtcacgag

SEQ ID NO: 6749 - DNA, 18 bp, Homo sapiens
tggtacgtctgtgggtag

SEQ ID NO: 6750 - DNA, 19 bp, Homo sapiens
tcgaggggtccccgtggcg

SEQ ID NO: 6751 - DNA, 22 bp, Homo sapiens
tcaagtaatccaggataggctg

SEQ ID NO: 6752 - DNA, 24 bp, Homo sapiens
ctgtaaacatcctcgactggaagc

SEQ ID NO: 6753 - DNA, 25 bp, Homo sapiens
ctgggatatctctgtcatcgtgggc

SEQ ID NO: 6754 - DNA, 24 bp, Homo sapiens
ttctgggtggtctggagatttgtg

SEQ ID NO: 6755 - DNA, 18 bp, Homo sapiens
gaggtagtaggttgtatg

SEQ ID NO: 6756 - DNA, 21 bp, Homo sapiens
cagcattgtacagggctatca

SEQ ID NO: 6757 - DNA, 22 bp, Homo sapiens
gggcagggaccttaccctagtc

SEQ ID NO: 6758 - DNA, 21 bp, Homo sapiens
ccgggactggccagtgttgag

SEQ ID NO: 6759 - DNA, 19 bp, Homo sapiens
gtccccttccccgccggcc

SEQ ID NO: 6760 - DNA, 19 bp, Homo sapiens
tactgcagacgtggcaatc

SEQ ID NO: 6761 - DNA, 22 bp, Homo sapiens
cggctacttcacaacaccaggg

SEQ ID NO: 6762 - DNA, 19 bp, Homo sapiens
gtgtgggggagaggctgtc

SEQ ID NO: 6763 - DNA, 18 bp, Homo sapiens
gtgtcttagctggttgtt

SEQ ID NO: 6764 - DNA, 21 bp, Homo sapiens
tgtctgctgtagatccctcaa

SEQ ID NO: 6765 - DNA, 19 bp, Homo sapiens
atacaatgtagatttctgt

SEQ ID NO: 6766 - DNA, 23 bp, Homo sapiens
actggctagggaaaatgattgga

SEQ ID NO: 6767 - DNA, 23 bp, Homo sapiens
cccatccgcgctctgactctctg

SEQ ID NO: 6768 - DNA, 21 bp, Homo sapiens
caggctcagtcccctcccgat

SEQ ID NO: 6769 - DNA, 20 bp, Homo sapiens
ctcaaaaagctgtcagtcac

SEQ ID NO: 6770 - DNA, 22 bp, Homo sapiens
cctgggcagcgtgtggctgaag

SEQ ID NO: 6771 - DNA, 19 bp, Homo sapiens
ctcagtagccagtgtagat

SEQ ID NO: 6772 - DNA, 22 bp, Homo sapiens
tgcacccgggcaaggattctga

SEQ ID NO: 6773 - DNA, 20 bp, Homo sapiens
gggttcctggcatgctgatt

SEQ ID NO: 6774 - DNA, 17 bp, Homo sapiens
cctggcgggcagctgtg

SEQ ID NO: 6775 - DNA, 21 bp, Homo sapiens
agcagcacatcatggtttaca

SEQ ID NO: 6776 - DNA, 19 bp, Homo sapiens
aagctcggtctgaggcccc

SEQ ID NO: 6777 - DNA, 21 bp, Homo sapiens
tttaggataagcttgactttt

SEQ ID NO: 6778 - DNA, 23 bp, Homo sapiens
tcagtagccagtgtagatcctgt

SEQ ID NO: 6779 - DNA, 22 bp, Homo sapiens
ttaggtagtttcatgttgttgg

SEQ ID NO: 6780 - DNA, 22 bp, Homo sapiens
tccgcgctctgactctctgccc

SEQ ID NO: 6781 - DNA, 22 bp, Homo sapiens
gaacattcaacgctgtcggtga

SEQ ID NO: 6782 - DNA, 24 bp, Homo sapiens
gagcctggaagctggagcctgcag

SEQ ID NO: 6783 - DNA, 17 bp, Homo sapiens
tgcaacttacctgagtc

SEQ ID NO: 6784 - DNA, 20 bp, Homo sapiens
tgcaacttacctgagtcatt

SEQ ID NO: 6785 - DNA, 21 bp, Homo sapiens
attgcttaagaatacgcgtag

SEQ ID NO: 6786 - DNA, 20 bp, Homo sapiens
aggggtgctatctgtgattg

SEQ ID NO: 6787 - DNA, 20 bp, Homo sapiens
taaggtgcatctagtgcagt

SEQ ID NO: 6788 - DNA, 17 bp, Homo sapiens
cgaccgttgattgtacc

SEQ ID NO: 6789 - DNA, 17 bp, Homo sapiens
atatctcaggctgtgac

SEQ ID NO: 6790 - DNA, 24 bp, Homo sapiens
ctgaagctcagagggctctgattc

SEQ ID NO: 6791 - DNA, 17 bp, Homo sapiens
actgtaaacgctttctg

SEQ ID NO: 6792 - DNA, 18 bp, Homo sapiens
tgcaccatggttgtctga

SEQ ID NO: 6793 - DNA, 19 bp, Homo sapiens
cggctctgggtctgtgggg

SEQ ID NO: 6794 - DNA, 17 bp, Homo sapiens
cggctctgggtctgtgg

SEQ ID NO: 6795 - DNA, 19 bp, Homo sapiens
ggacggagaactgataagg

SEQ ID NO: 6796 - DNA, 18 bp, Homo sapiens
ggacggagaactgataag

SEQ ID NO: 6797 - DNA, 15 bp, Homo sapiens
tagatccgaacttgt

SEQ ID NO: 6798 - DNA, 21 bp, Homo sapiens
atacaagggcaagctctctgt

SEQ ID NO: 6799 - DNA, 21 bp, Homo sapiens
gagactgatgagttcccggga

SEQ ID NO: 6800 - DNA, 19 bp, Homo sapiens
gcaggaacttgtgagtctc

SEQ ID NO: 6801 - DNA, 20 bp, Homo sapiens
tatggtttgcctgggactga

SEQ ID NO: 6802 - DNA, 24 bp, Homo sapiens
tatcagactgatgttgactgttga

SEQ ID NO: 6803 - DNA, 20 bp, Homo sapiens
tcaaacgccattatcacact

SEQ ID NO: 6804 - DNA, 18 bp, Homo sapiens
cagtgcaatgatgaaagg

SEQ ID NO: 6805 - DNA, 20 bp, Homo sapiens
gcggcggcggtggtgggggg

SEQ ID NO: 6806 - DNA, 21 bp, Homo sapiens
gctgatgtttgacccttgagc

SEQ ID NO: 6807 - DNA, 20 bp, Homo sapiens
tgatatgtttgatattgggt

SEQ ID NO: 6808 - DNA, 20 bp, Homo sapiens
tatacctcagttttatcagg

SEQ ID NO: 6809 - DNA, 19 bp, Homo sapiens
gcagtgacctgaatcaggt

SEQ ID NO: 6810 - DNA, 23 bp, Homo sapiens
gcatgcctctgctgctggccaga

SEQ ID NO: 6811 - DNA, 22 bp, Homo sapiens
ctcactcctctcctcccgtctt

SEQ ID NO: 6812 - DNA, 21 bp, Homo sapiens
tgcaggaacttgtgagtctcc

SEQ ID NO: 6813 - DNA, 19 bp, Homo sapiens
tgcaggaacttgtgagtct

SEQ ID NO: 6814 - DNA, 22 bp, Homo sapiens
agaagcattctttcattggttg

SEQ ID NO: 6815 - DNA, 21 bp, Homo sapiens
cgtccccttccccgccggccg

SEQ ID NO: 6816 - DNA, 22 bp, Homo sapiens
cgtccccttccccgccggccgc

SEQ ID NO: 6817 - DNA, 18 bp, Homo sapiens
agctggtgttgtgaatca

SEQ ID NO: 6818 - DNA, 26 bp, Homo sapiens
atggcactggtagaattcactgtgaa

SEQ ID NO: 6819 - DNA, 27 bp, Homo sapiens
atggcactggtagaattcactgtgaac

SEQ ID NO: 6820 - DNA, 22 bp, Homo sapiens
actggatcaattataggagtga

SEQ ID NO: 6821 - DNA, 16 bp, Homo sapiens
tggtcgaccagttgga

SEQ ID NO: 6822 - DNA, 17 bp, Homo sapiens
tggtcgaccagttggaa

SEQ ID NO: 6823 - DNA, 18 bp, Homo sapiens
tggtcgaccagttggaaa

SEQ ID NO: 6824 - DNA, 15 bp, Homo sapiens
tggtcgaccagttgg

SEQ ID NO: 6825 - DNA, 25 bp, Homo sapiens
agacgggaggaaagaagggagtggt

SEQ ID NO: 6826 - DNA, 19 bp, Homo sapiens
atacctgtgtgtgatgagc

SEQ ID NO: 6827 - DNA, 20 bp, Homo sapiens
gatacctgtgtgtgatgagc

SEQ ID NO: 6828 - DNA, 20 bp, Homo sapiens
atacgacctgctgcctttct

SEQ ID NO: 6829 - DNA, 21 bp, Homo sapiens
cggctctgggtctgtggggag

SEQ ID NO: 6830 - DNA, 20 bp, Homo sapiens
cacctcccctgcaaacgtcc

SEQ ID NO: 6831 - DNA, 18 bp, Homo sapiens
ttaatatcggacaaccat

SEQ ID NO: 6832 - DNA, 19 bp, Homo sapiens
accaggaggctgaggcccc

SEQ ID NO: 6833 - DNA, 23 bp, Homo sapiens
tttaactttgatggcaaaggggt

SEQ ID NO: 6834 - DNA, 21 bp, Homo sapiens
gcggcggcggtggtgggggga

SEQ ID NO: 6835 - DNA, 20 bp, Homo sapiens
ctcgaggggtccccgtggcg

SEQ ID NO: 6836 - DNA, 23 bp, Homo sapiens
atcctgtactgagctgccccgag

SEQ ID NO: 6837 - DNA, 18 bp, Homo sapiens
gtactgagctgccccgag

SEQ ID NO: 6838 - DNA, 22 bp, Homo sapiens
gaagcccttaccccaaaaagta

SEQ ID NO: 6839 - DNA, 22 bp, Homo sapiens
cccttgggtctgatggggtagc

SEQ ID NO: 6840 - DNA, 19 bp, Homo sapiens
atccaggtctggggcatga

SEQ ID NO: 6841 - DNA, 20 bp, Homo sapiens
ttgctgtgggggagaggggg

SEQ ID NO: 6842 - DNA, 22 bp, Homo sapiens
tcgaggggtccccgtggcgtcc

SEQ ID NO: 6843 - DNA, 23 bp, Homo sapiens
gctacattgtctgctgggtttca

SEQ ID NO: 6844 - DNA, 21 bp, Homo sapiens
tcgaggggtccccgtggcgtc

SEQ ID NO: 6845 - DNA, 20 bp, Homo sapiens
gctgggaaggcaaagggacg

SEQ ID NO: 6846 - DNA, 21 bp, Homo sapiens
cctctaaagggaagcgctttc

SEQ ID NO: 6847 - DNA, 21 bp, Homo sapiens
agaggctttgtgcggatacgg

SEQ ID NO: 6848 - DNA, 20 bp, Homo sapiens
aaaagctgggttgagaggat

SEQ ID NO: 6849 - DNA, 22 bp, Homo sapiens
actatatatcaaacatattcct

SEQ ID NO: 6850 - DNA, 23 bp, Homo sapiens
gagcctggaagctggagcctgca

SEQ ID NO: 6851 - DNA, 22 bp, Homo sapiens
ggccgcgctcgaggggtccccg

SEQ ID NO: 6852 - DNA, 19 bp, Homo sapiens
ggccgcgctcgaggggtcc

SEQ ID NO: 6853 - DNA, 17 bp, Homo sapiens
ggccgcgctcgaggggt

SEQ ID NO: 6854 - DNA, 19 bp, Homo sapiens
accgccctcgtgtctgtgg

SEQ ID NO: 6855 - DNA, 20 bp, Homo sapiens
agctgggttgagagggcgaa

SEQ ID NO: 6856 - DNA, 23 bp, Homo sapiens
ttctccaaaagggagcactttct

SEQ ID NO: 6857 - DNA, 24 bp, Homo sapiens
tgggaacgggttccggcagacgct

SEQ ID NO: 6858 - DNA, 22 bp, Homo sapiens
gaactctgtcttcactcatgag

SEQ ID NO: 6859 - DNA, 19 bp, Homo sapiens
ttgcacttgtcccggcctg

SEQ ID NO: 6860 - DNA, 20 bp, Homo sapiens
gcatcccctcagcctgtggc

SEQ ID NO: 6861 - DNA, 23 bp, Homo sapiens
aaagtgcatccttttagagtgtt

SEQ ID NO: 6862 - DNA, 16 bp, Homo sapiens
tcttcccggagtcggg

SEQ ID NO: 6863 - DNA, 19 bp, Homo sapiens
tcagtagccagtgtagatc

SEQ ID NO: 6864 - DNA, 20 bp, Homo sapiens
tcagtagccagtgtagatcc

SEQ ID NO: 6865 - DNA, 18 bp, Homo sapiens
gcagcacgtaaatattgg

SEQ ID NO: 6866 - DNA, 22 bp, Homo sapiens
catccgcgctctgactctctgc

SEQ ID NO: 6867 - DNA, 24 bp, Homo sapiens
gaccgatttctcctggtgttcaga

SEQ ID NO: 6868 - DNA, 21 bp, Homo sapiens
ttgctgtgggggagaggggga

SEQ ID NO: 6869 - DNA, 19 bp, Homo sapiens
aaacatggttccgtcaagc

SEQ ID NO: 6870 - DNA, 19 bp, Homo sapiens
atgcacccgggcaaggatt

SEQ ID NO: 6871 - DNA, 20 bp, Homo sapiens
acattcaacctgtcggtgag

SEQ ID NO: 6872 - DNA, 22 bp, Homo sapiens
ttcctcactcccgtgaagtcgg

SEQ ID NO: 6873 - DNA, 21 bp, Homo sapiens
agtggcacatgtttgttgtga

SEQ ID NO: 6874 - DNA, 18 bp, Homo sapiens
gactgttgaatctcatgg

SEQ ID NO: 6875 - DNA, 23 bp, Homo sapiens
gggatcgccgagggccggtcggc

SEQ ID NO: 6876 - DNA, 20 bp, Homo sapiens
gcggggcgccgcgggaccgc

SEQ ID NO: 6877 - DNA, 24 bp, Homo sapiens
tgtgactggttgaccagaggggca

SEQ ID NO: 6878 - DNA, 22 bp, Homo sapiens
ccacctgccgcgccccccgggc

SEQ ID NO: 6879 - DNA, 19 bp, Homo sapiens
aatccttggaacctaggtg

SEQ ID NO: 6880 - DNA, 18 bp, Homo sapiens
gctggtttcacatggtgg

SEQ ID NO: 6881 - DNA, 23 bp, Homo sapiens
attcaagtaatccaggataggct

SEQ ID NO: 6882 - DNA, 23 bp, Homo sapiens
ctggtttcatatggtggtttaga

SEQ ID NO: 6883 - DNA, 27 bp, Homo sapiens
tgcaccatggttgtctgagcatgcagc

SEQ ID NO: 6884 - DNA, 18 bp, Homo sapiens
taacagtctccagtcacg

SEQ ID NO: 6885 - DNA, 20 bp, Homo sapiens
gtaaggcacccttctgagta

SEQ ID NO: 6886 - DNA, 17 bp, Homo sapiens
aacgccattatcacact

SEQ ID NO: 6887 - DNA, 23 bp, Homo sapiens
tactcaaaatgggggcgctttcc

SEQ ID NO: 6888 - DNA, 20 bp, Homo sapiens
ctgctatgccaacatattgc

SEQ ID NO: 6889 - DNA, 21 bp, Homo sapiens
ctgctatgccaacatattgcc

SEQ ID NO: 6890 - DNA, 22 bp, Homo sapiens
aagcgcttccctttgctggatt

SEQ ID NO: 6891 - DNA, 17 bp, Homo sapiens
agtgcttacagtgcagg

SEQ ID NO: 6892 - DNA, 17 bp, Homo sapiens
tagtagtttgtgctgtt

SEQ ID NO: 6893 - DNA, 19 bp, Homo sapiens
atagtagaccgtatagcgt

SEQ ID NO: 6894 - DNA, 15 bp, Homo sapiens
cttgtcccggcctgt

SEQ ID NO: 6895 - DNA, 19 bp, Homo sapiens
atgcagtccatgggcatat

SEQ ID NO: 6896 - DNA, 19 bp, Homo sapiens
catgctgtgtgtggtaccc

SEQ ID NO: 6897 - DNA, 22 bp, Homo sapiens
tgttcctctgtctcccagactc

SEQ ID NO: 6898 - DNA, 22 bp, Homo sapiens
gggaccatcctgcctgctgtgg

SEQ ID NO: 6899 - DNA, 19 bp, Homo sapiens
cagcacagaaatattggca

SEQ ID NO: 6900 - DNA, 18 bp, Homo sapiens
tgcgacgtgtggcgtggg

SEQ ID NO: 6901 - DNA, 19 bp, Homo sapiens
tgttctcttcactgtggga

SEQ ID NO: 6902 - DNA, 19 bp, Homo sapiens
cggggattggtctgtggtc

SEQ ID NO: 6903 - DNA, 18 bp, Homo sapiens
cctgtagaaccgaatttg

SEQ ID NO: 6904 - DNA, 19 bp, Homo sapiens
ccgaccctgagctctgcca

SEQ ID NO: 6905 - DNA, 21 bp, Homo sapiens
ctctagctgccaaaggcgctt

SEQ ID NO: 6906 - DNA, 23 bp, Homo sapiens
cctgactccaggtcctgtgtgtt

SEQ ID NO: 6907 - DNA, 23 bp, Homo sapiens
ctgggaggtggatgtttacttca

SEQ ID NO: 6908 - DNA, 23 bp, Homo sapiens
ctgcgcaagctactgccttgcta

SEQ ID NO: 6909 - DNA, 21 bp, Homo sapiens
caccgcggtcttttcctccca

SEQ ID NO: 6910 - DNA, 21 bp, Homo sapiens
tacccagtctccggtgcagcc

SEQ ID NO: 6911 - DNA, 20 bp, Homo sapiens
agttctggtatcgttgctgc

SEQ ID NO: 6912 - DNA, 20 bp, Homo sapiens
gtgagtcagggtggggctgg

SEQ ID NO: 6913 - DNA, 24 bp, Homo sapiens
taaggcacgcggtgaatgccaaga

SEQ ID NO: 6914 - DNA, 20 bp, Homo sapiens
attgacacctctgtgagtgg

SEQ ID NO: 6915 - DNA, 20 bp, Homo sapiens
gaggtagtagtttgtgctgt

SEQ ID NO: 6916 - DNA, 22 bp, Homo sapiens
aggggcagagagcgagactttt

SEQ ID NO: 6917 - DNA, 26 bp, Homo sapiens
ttcaagtaatccaggataggctgtgc

SEQ ID NO: 6918 - DNA, 23 bp, Homo sapiens
ggtcggccgcgctcgaggggtcc

SEQ ID NO: 6919 - DNA, 21 bp, Homo sapiens
tatacggcctcctagctttcc

SEQ ID NO: 6920 - DNA, 22 bp, Homo sapiens
cagcccggatcccagcccactt

SEQ ID NO: 6921 - DNA, 21 bp, Homo sapiens
ttcttacccaccatggccaaa

SEQ ID NO: 6922 - DNA, 20 bp, Homo sapiens
ttcttacccaccatggccaa

SEQ ID NO: 6923 - DNA, 18 bp, Homo sapiens
cccgtagaaccgaccttg

SEQ ID NO: 6924 - DNA, 22 bp, Homo sapiens
actgctagctgtagaactccag

SEQ ID NO: 6925 - DNA, 23 bp, Homo sapiens
actgctagctgtagaactccagc

SEQ ID NO: 6926 - DNA, 21 bp, Homo sapiens
tacttggaaaggcatcagttg

SEQ ID NO: 6927 - DNA, 25 bp, Homo sapiens
caacattcattgctgtcggtgggtt

SEQ ID NO: 6928 - DNA, 19 bp, Homo sapiens
ctgtctcagagcctggagt

SEQ ID NO: 6929 - DNA, 19 bp, Homo sapiens
acgcccttcccccccttct

SEQ ID NO: 6930 - DNA, 20 bp, Homo sapiens
acgcccttcccccccttctt

SEQ ID NO: 6931 - DNA, 20 bp, Homo sapiens
gggagccaggaagtattgat

SEQ ID NO: 6932 - DNA, 18 bp, Homo sapiens
ctttgtcatccttcgcct

SEQ ID NO: 6933 - DNA, 23 bp, Homo sapiens
aaaagctgggttgagagggtaga

SEQ ID NO: 6934 - DNA, 25 bp, Homo sapiens
ttcaagtaatccaggataggctgtg

SEQ ID NO: 6935 - DNA, 21 bp, Homo sapiens
atgattgtagccttttggagt

SEQ ID NO: 6936 - DNA, 21 bp, Homo sapiens
tctctcggctcctcgcggctc

SEQ ID NO: 6937 - DNA, 23 bp, Homo sapiens
ctacaaagggaagccctttctgt

SEQ ID NO: 6938 - DNA, 19 bp, Homo sapiens
gtggttatccctgctgtgt

SEQ ID NO: 6939 - DNA, 20 bp, Homo sapiens
gtggttatccctgctgtgtt

SEQ ID NO: 6940 - DNA, 24 bp, Homo sapiens
caaagtgcctccctttagagtgtt

SEQ ID NO: 6941 - DNA, 20 bp, Homo sapiens
ctcgtgtcttgtgttgcagc

SEQ ID NO: 6942 - DNA, 21 bp, Homo sapiens
ctcgtgtcttgtgttgcagcc

SEQ ID NO: 6943 - DNA, 20 bp, Homo sapiens
gaacggcttcatacaggagt

SEQ ID NO: 6944 - DNA, 21 bp, Homo sapiens
actgcagacgtggcaatcatg

SEQ ID NO: 6945 - DNA, 21 bp, Homo sapiens
tcagtcggatgtttgcagctg

SEQ ID NO: 6946 - DNA, 23 bp, Homo sapiens
atggaatgtaaagaagtatgtat

SEQ ID NO: 6947 - DNA, 21 bp, Homo sapiens
caccagccctgtgttccctag

SEQ ID NO: 6948 - DNA, 20 bp, Homo sapiens
actcagccttgagggcactt

SEQ ID NO: 6949 - DNA, 17 bp, Homo sapiens
aaggcagggcccccgct

SEQ ID NO: 6950 - DNA, 18 bp, Homo sapiens
aaggcagggcccccgctc

SEQ ID NO: 6951 - DNA, 18 bp, Homo sapiens
gtgcttatagtgcaggta

SEQ ID NO: 6952 - DNA, 17 bp, Homo sapiens
cgtggcgtcggtcgtgg

SEQ ID NO: 6953 - DNA, 17 bp, Homo sapiens
ctgggttgagagggcga

SEQ ID NO: 6954 - DNA, 19 bp, Homo sapiens
caaatcacagtctgccata

SEQ ID NO: 6955 - DNA, 20 bp, Homo sapiens
ggtctttgcgggcgagatga

SEQ ID NO: 6956 - DNA, 22 bp, Homo sapiens
atgcacctgggcaaggattcag

SEQ ID NO: 6957 - DNA, 19 bp, Homo sapiens
gagggttgggtggaggctc

SEQ ID NO: 6958 - DNA, 23 bp, Homo sapiens
cctgggcagcgtgtggctgaagg

SEQ ID NO: 6959 - DNA, 22 bp, Homo sapiens
agggccccccctcaatcctgtt

SEQ ID NO: 6960 - DNA, 24 bp, Homo sapiens
acaagtcaggctcttgggacctag

SEQ ID NO: 6961 - DNA, 19 bp, Homo sapiens
ttttgcgatgtgttcctaa

SEQ ID NO: 6962 - DNA, 21 bp, Homo sapiens
ccttgcgctactcaggtctgc

SEQ ID NO: 6963 - DNA, 20 bp, Homo sapiens
tggccatgtgacttgtgggc

SEQ ID NO: 6964 - DNA, 24 bp, Homo sapiens
caaagcgctcccctttagaggttt

SEQ ID NO: 6965 - DNA, 19 bp, Homo sapiens
agtgcactacagaactttg

SEQ ID NO: 6966 - DNA, 20 bp, Homo sapiens
agtcatacacggctctcctc

SEQ ID NO: 6967 - DNA, 17 bp, Homo sapiens
cggaatcccaaaagcag

SEQ ID NO: 6968 - DNA, 19 bp, Homo sapiens
cggacaggcgttcgtgcga

SEQ ID NO: 6969 - DNA, 18 bp, Homo sapiens
cggacaggcgttcgtgcg

SEQ ID NO: 6970 - DNA, 20 bp, Homo sapiens
tatacaacctactgccttcc

SEQ ID NO: 6971 - DNA, 22 bp, Homo sapiens
gttcacagtggctaagttccgc

SEQ ID NO: 6972 - DNA, 18 bp, Homo sapiens
tgctatgccaacatattg

SEQ ID NO: 6973 - DNA, 23 bp, Homo sapiens
aggttctgtgatacactccgact

SEQ ID NO: 6974 - DNA, 23 bp, Homo sapiens
gtgtgtgactggttgaccagagg

SEQ ID NO: 6975 - DNA, 22 bp, Homo sapiens
tcgacagcacgacactgccttc

SEQ ID NO: 6976 - DNA, 23 bp, Homo sapiens
caccgcggtcttttcctcccact

SEQ ID NO: 6977 - DNA, 20 bp, Homo sapiens
ttgagaactgaattccatgg

SEQ ID NO: 6978 - DNA, 18 bp, Homo sapiens
catagaggctgtggctgg

SEQ ID NO: 6979 - DNA, 22 bp, Homo sapiens
gggggaccggccgcgactgcgg

SEQ ID NO: 6980 - DNA, 21 bp, Homo sapiens
gggggaccggccgcgactgcg

SEQ ID NO: 6981 - DNA, 22 bp, Homo sapiens
tatcagattgtattgtaattgt

SEQ ID NO: 6982 - DNA, 19 bp, Homo sapiens
atgctcagactcctgtggt

SEQ ID NO: 6983 - DNA, 24 bp, Homo sapiens
ggggccgtagcactgtctgagagg

SEQ ID NO: 6984 - DNA, 21 bp, Homo sapiens
tactgtagtatgggcacttcc

SEQ ID NO: 6985 - DNA, 25 bp, Homo sapiens
tgattggtacgtctgtgggtagagt

SEQ ID NO: 6986 - DNA, 22 bp, Homo sapiens
actggagtttgtttcaatattg

SEQ ID NO: 6987 - DNA, 23 bp, Homo sapiens
ctgccctaagtgctccttctggc

SEQ ID NO: 6988 - DNA, 21 bp, Homo sapiens
actgtgtcctttctgcgtaga

SEQ ID NO: 6989 - DNA, 17 bp, Homo sapiens
gctgactcctagtccag

SEQ ID NO: 6990 - DNA, 25 bp, Homo sapiens
taccctgtagaaccgaatttgtgtg

SEQ ID NO: 6991 - DNA, 22 bp, Homo sapiens
ccactgaccgttgactgtacct

SEQ ID NO: 6992 - DNA, 22 bp, Homo sapiens
gagactgatgagttcccgggaa

SEQ ID NO: 6993 - DNA, 17 bp, Homo sapiens
taatactgccgggtaat

SEQ ID NO: 6994 - DNA, 16 bp, Homo sapiens
taatactgccgggtaa

SEQ ID NO: 6995 - DNA, 23 bp, Homo sapiens
cagctacattgtctgctgggttt

SEQ ID NO: 6996 - DNA, 21 bp, Homo sapiens
caggcgttcgtgcgacgtgtg

SEQ ID NO: 6997 - DNA, 22 bp, Homo sapiens
caggcgttcgtgcgacgtgtgg

SEQ ID NO: 6998 - DNA, 18 bp, Homo sapiens
gttcggcgcgcgcgtgcg

SEQ ID NO: 6999 - DNA, 19 bp, Homo sapiens
aggcacgcggtgaatgcca

SEQ ID NO: 7000 - DNA, 24 bp, Homo sapiens
gtttgataagctgacatgggacag

SEQ ID NO: 7001 - DNA, 23 bp, Homo sapiens
tggtttaccgtcccacatacatt

SEQ ID NO: 7002 - DNA, 21 bp, Homo sapiens
cagttatcacagtgctgatgc

SEQ ID NO: 7003 - DNA, 21 bp, Homo sapiens
ctctcaccactgccctcccac

SEQ ID NO: 7004 - DNA, 20 bp, Homo sapiens
cgttcggcgcgcgcgtgcgc

SEQ ID NO: 7005 - DNA, 21 bp, Homo sapiens
cacctcccctgcaaacgtcca

SEQ ID NO: 7006 - DNA, 21 bp, Homo sapiens
acctggcatacaatgtagatt

SEQ ID NO: 7007 - DNA, 16 bp, Homo sapiens
tagtagtttgtgctgt

SEQ ID NO: 7008 - DNA, 20 bp, Homo sapiens
ccgagggccggtcggccgcc

SEQ ID NO: 7009 - DNA, 25 bp, Homo sapiens
tggttgaccagagagcacacgcttt

SEQ ID NO: 7010 - DNA, 22 bp, Homo sapiens
cagttgctagttgcactcctct

SEQ ID NO: 7011 - DNA, 20 bp, Homo sapiens
tggctttttattcctatgtg

SEQ ID NO: 7012 - DNA, 20 bp, Homo sapiens
caccaccttctccacccagc

SEQ ID NO: 7013 - DNA, 30 bp, Homo sapiens
ggtcggccgcgctcgaggggtccccgtggc

SEQ ID NO: 7014 - DNA, 20 bp, Homo sapiens
tcaaagtgcttacagtgcag

SEQ ID NO: 7015 - DNA, 20 bp, Homo sapiens
ttgcagacactaggaccatg

SEQ ID NO: 7016 - DNA, 21 bp, Homo sapiens
ggcgtccccttccccgccggc

SEQ ID NO: 7017 - DNA, 20 bp, Homo sapiens
gtcactagtggttccgttta

SEQ ID NO: 7018 - DNA, 20 bp, Homo sapiens
cgtgtcttgtgttgcagccg

SEQ ID NO: 7019 - DNA, 16 bp, Homo sapiens
gtgacaatggtgtttg

SEQ ID NO: 7020 - DNA, 19 bp, Homo sapiens
ttgattgacacttctgtga

SEQ ID NO: 7021 - DNA, 18 bp, Homo sapiens
ccatggatctccaggtgg

SEQ ID NO: 7022 - DNA, 19 bp, Homo sapiens
ccatggatctccaggtggg

SEQ ID NO: 7023 - DNA, 19 bp, Homo sapiens
acaagggcaagctctctgt

SEQ ID NO: 7024 - DNA, 19 bp, Homo sapiens
tctctcggctcctcgcggc

SEQ ID NO: 7025 - DNA, 18 bp, Homo sapiens
tctctcggctcctcgcgg

SEQ ID NO: 7026 - DNA, 17 bp, Homo sapiens
ggtagtagtttgtacag

SEQ ID NO: 7027 - DNA, 18 bp, Homo sapiens
cactgtctggtaacgatg

SEQ ID NO: 7028 - DNA, 16 bp, Homo sapiens
atccttgactggaagc

SEQ ID NO: 7029 - DNA, 18 bp, Homo sapiens
gtcaacacttgctggttt

SEQ ID NO: 7030 - DNA, 20 bp, Homo sapiens
gggaccggccgcgactgcgg

SEQ ID NO: 7031 - DNA, 23 bp, Homo sapiens
gtttgataagctgacatgggaca

SEQ ID NO: 7032 - DNA, 19 bp, Homo sapiens
cccaacccttgtaccagtg

SEQ ID NO: 7033 - DNA, 18 bp, Homo sapiens
cactggtgctctgtggga

SEQ ID NO: 7034 - DNA, 17 bp, Homo sapiens
tcacagtgaaccggtct

SEQ ID NO: 7035 - DNA, 21 bp, Homo sapiens
cgccccgggtgccgcgcggtg

SEQ ID NO: 7036 - DNA, 19 bp, Homo sapiens
tgactgttgaatctcatgg

SEQ ID NO: 7037 - DNA, 20 bp, Homo sapiens
agtgcaatgttaaaagggca

SEQ ID NO: 7038 - DNA, 23 bp, Homo sapiens
tcgtacagggtcatccacttttt

SEQ ID NO: 7039 - DNA, 21 bp, Homo sapiens
ttgctagttgcactcctctct

SEQ ID NO: 7040 - DNA, 20 bp, Homo sapiens
acactgtctggtaacgatgt

SEQ ID NO: 7041 - DNA, 20 bp, Homo sapiens
gagactgatgagttcccggg

SEQ ID NO: 7042 - DNA, 20 bp, Homo sapiens
agtaagtgcttccatgtttt

SEQ ID NO: 7043 - DNA, 19 bp, Homo sapiens
ttgaaaggctatttcttgg

SEQ ID NO: 7044 - DNA, 18 bp, Homo sapiens
gagcgtcctggctgatga

SEQ ID NO: 7045 - DNA, 20 bp, Homo sapiens
gtaacagtctccagtcacgg

SEQ ID NO: 7046 - DNA, 23 bp, Homo sapiens
ggtgcctactgagctgatatcag

SEQ ID NO: 7047 - DNA, 22 bp, Homo sapiens
cccagataatggcactctcaaa

SEQ ID NO: 7048 - DNA, 26 bp, Homo sapiens
ctggagcaagatctcaggctgtgacc

SEQ ID NO: 7049 - DNA, 22 bp, Homo sapiens
cgggggaccggccgcgactgcg

SEQ ID NO: 7050 - DNA, 19 bp, Homo sapiens
ctgcagtgaaggcacttgt

SEQ ID NO: 7051 - DNA, 20 bp, Homo sapiens
ggggttcctggggatgggat

SEQ ID NO: 7052 - DNA, 22 bp, Homo sapiens
tcaccctgcatcccgcacccag

SEQ ID NO: 7053 - DNA, 15 bp, Homo sapiens
ttctgtagcgcaatt

SEQ ID NO: 7054 - DNA, 26 bp, Homo sapiens
tggtagactatggaacgtaggcgtta

SEQ ID NO: 7055 - DNA, 25 bp, Homo sapiens
tggtagactatggaacgtaggcgtt

SEQ ID NO: 7056 - DNA, 23 bp, Homo sapiens
tggtagactatggaacgtaggcg

SEQ ID NO: 7057 - DNA, 19 bp, Homo sapiens
gttttcccaggaatccctt

SEQ ID NO: 7058 - DNA, 20 bp, Homo sapiens
tcctttgtccctgggtgaga

SEQ ID NO: 7059 - DNA, 19 bp, Homo sapiens
tctgtctgtcttctgtata

SEQ ID NO: 7060 - DNA, 24 bp, Homo sapiens
tagcagcacgtaaatattggcgta

SEQ ID NO: 7061 - DNA, 24 bp, Homo sapiens
tggaatgtaaagaagtatgtattt

SEQ ID NO: 7062 - DNA, 23 bp, Homo sapiens
ttgtacatggtaggctttcattc

SEQ ID NO: 7063 - DNA, 18 bp, Homo sapiens
ctgggttgagagggcgaa

SEQ ID NO: 7064 - DNA, 18 bp, Homo sapiens
caggtcacgtctctgcag

SEQ ID NO: 7065 - DNA, 22 bp, Homo sapiens
aaagtgctgtcatagctgaggt

SEQ ID NO: 7066 - DNA, 18 bp, Homo sapiens
cggggttttgagggcgag

SEQ ID NO: 7067 - DNA, 24 bp, Homo sapiens
tgagatgaagcactgtagctcagg

SEQ ID NO: 7068 - DNA, 20 bp, Homo sapiens
tcggctctgggtctgtgggg

SEQ ID NO: 7069 - DNA, 22 bp, Homo sapiens
ctgacgtgcggtacttaatgag

SEQ ID NO: 7070 - DNA, 19 bp, Homo sapiens
gcacgtaaatattggcgtt

SEQ ID NO: 7071 - DNA, 23 bp, Homo sapiens
cgggaccgccctcgtgtctgtgg

SEQ ID NO: 7072 - DNA, 24 bp, Homo sapiens
ctcctgactccaggtcctgtgtgt

SEQ ID NO: 7073 - DNA, 21 bp, Homo sapiens
tggctttttattcctatgtga

SEQ ID NO: 7074 - DNA, 20 bp, Homo sapiens
agcgaggttgccctttgtat

SEQ ID NO: 7075 - DNA, 22 bp, Homo sapiens
agaactgaattccataggctgt

SEQ ID NO: 7076 - DNA, 20 bp, Homo sapiens
ggactccatttgttttgatg

SEQ ID NO: 7077 - DNA, 19 bp, Homo sapiens
aggggctggctttcctctg

SEQ ID NO: 7078 - DNA, 21 bp, Homo sapiens
tactcagaaaggtgccagtca

SEQ ID NO: 7079 - DNA, 18 bp, Homo sapiens
tgctggatcagtggttcg

SEQ ID NO: 7080 - DNA, 22 bp, Homo sapiens
gattgtccaaacgcaattcttg

SEQ ID NO: 7081 - DNA, 17 bp, Homo sapiens
taagaagttgactgaag

SEQ ID NO: 7082 - DNA, 22 bp, Homo sapiens
gtttgataagctgacatgggac

SEQ ID NO: 7083 - DNA, 20 bp, Homo sapiens
tacagcaggcacagacaggc

SEQ ID NO: 7084 - DNA, 24 bp, Homo sapiens
tttgataagctgacatgggacagg

SEQ ID NO: 7085 - DNA, 19 bp, Homo sapiens
aacatcctacactctcagc

SEQ ID NO: 7086 - DNA, 20 bp, Homo sapiens
actagtaatgttggattagg

SEQ ID NO: 7087 - DNA, 21 bp, Homo sapiens
cagctgcctgggagtgacttc

SEQ ID NO: 7088 - DNA, 30 bp, Homo sapiens
cttcctgagcacgctcatgatgagcaaact

SEQ ID NO: 7089 - DNA, 23 bp, Homo sapiens
ttggccatggggctgcgcggggc

SEQ ID NO: 7090 - DNA, 22 bp, Homo sapiens
ttggccatggggctgcgcgggg

SEQ ID NO: 7091 - DNA, 21 bp, Homo sapiens
ttggccatggggctgcgcggg

SEQ ID NO: 7092 - DNA, 23 bp, Homo sapiens
aaaactccttcaagatcgccggg

SEQ ID NO: 7093 - DNA, 16 bp, Homo sapiens
catcgggaatgtcgtg

SEQ ID NO: 7094 - DNA, 22 bp, Homo sapiens
actgccttaggagaaagtttct

SEQ ID NO: 7095 - DNA, 23 bp, Homo sapiens
cagatgggctttcagtcggatgt

SEQ ID NO: 7096 - DNA, 21 bp, Homo sapiens
ggtcggccgcgctcgaggggt

SEQ ID NO: 7097 - DNA, 20 bp, Homo sapiens
aagtgcttcgattttggggt

SEQ ID NO: 7098 - DNA, 20 bp, Homo sapiens
tccctttgtcatcctatgcc

SEQ ID NO: 7099 - DNA, 21 bp, Homo sapiens
tgggtggtctggagatttgtg

SEQ ID NO: 7100 - DNA, 22 bp, Homo sapiens
tcttgttcagaaagtctgttgt

SEQ ID NO: 7101 - DNA, 18 bp, Homo sapiens
aactgaattccatgggtt

SEQ ID NO: 7102 - DNA, 23 bp, Homo sapiens
gaaagtgcttctctttggtgggt

SEQ ID NO: 7103 - DNA, 19 bp, Homo sapiens
aatgcacctgggcaaggat

SEQ ID NO: 7104 - DNA, 19 bp, Homo sapiens
cagttttcccaggaatccc

SEQ ID NO: 7105 - DNA, 17 bp, Homo sapiens
gggcgccgcgggaccgc

SEQ ID NO: 7106 - DNA, 17 bp, Homo sapiens
ttctcaagagggaggca

SEQ ID NO: 7107 - DNA, 23 bp, Homo sapiens
gaggccccgcgcgtgtgtcccgg

SEQ ID NO: 7108 - DNA, 24 bp, Homo sapiens
gaggccccgcgcgtgtgtcccggc

SEQ ID NO: 7109 - DNA, 23 bp, Homo sapiens
agaagaaagatctggaagtggga

SEQ ID NO: 7110 - DNA, 22 bp, Homo sapiens
tgactcccagggactgccttag

SEQ ID NO: 7111 - DNA, 22 bp, Homo sapiens
gcgtccccttccccgccggccg

SEQ ID NO: 7112 - DNA, 23 bp, Homo sapiens
gcgtccccttccccgccggccgc

SEQ ID NO: 7113 - DNA, 21 bp, Homo sapiens
cgctttgctcagccagtgtag

SEQ ID NO: 7114 - DNA, 22 bp, Homo sapiens
gcctctaagaagttgactgaag

SEQ ID NO: 7115 - DNA, 23 bp, Homo sapiens
aagtcactagtggttccgtttag

SEQ ID NO: 7116 - DNA, 18 bp, Homo sapiens
tccattacactaccctgc

SEQ ID NO: 7117 - DNA, 21 bp, Homo sapiens
ataatacaacctgctaagtgt

SEQ ID NO: 7118 - DNA, 18 bp, Homo sapiens
cggggattggtctgtggt

SEQ ID NO: 7119 - DNA, 18 bp, Homo sapiens
ttttgcgatgtgttccta

SEQ ID NO: 7120 - DNA, 30 bp, Homo sapiens
tcagtgtcagacctctgaaattcagttctt

SEQ ID NO: 7121 - DNA, 24 bp, Homo sapiens
caaagtgcttccctttagagtgtt

SEQ ID NO: 7122 - DNA, 22 bp, Homo sapiens
cagctacattgtctgctgggtt

SEQ ID NO: 7123 - DNA, 21 bp, Homo sapiens
tcttattggctggaaaggaag

SEQ ID NO: 7124 - DNA, 16 bp, Homo sapiens
ctcggcgtggcgtcgg

SEQ ID NO: 7125 - DNA, 23 bp, Homo sapiens
gaaagcgcttctctttagaggat

SEQ ID NO: 7126 - DNA, 24 bp, Homo sapiens
tgaccgatttctcctggtgttcag

SEQ ID NO: 7127 - DNA, 21 bp, Homo sapiens
acctggacccagcgtagacaa

SEQ ID NO: 7128 - DNA, 22 bp, Homo sapiens
caaatctccggaccacttagtc

SEQ ID NO: 7129 - DNA, 20 bp, Homo sapiens
ctgcgcttggatttcgtccc

SEQ ID NO: 7130 - DNA, 22 bp, Homo sapiens
gactccagttttagttctcttg

SEQ ID NO: 7131 - DNA, 19 bp, Homo sapiens
tgcagctgcctgggagtga

SEQ ID NO: 7132 - DNA, 20 bp, Homo sapiens
cggggatcgccgagggccgg

SEQ ID NO: 7133 - DNA, 23 bp, Homo sapiens
taaacatccttgactggaagctg

SEQ ID NO: 7134 - DNA, 21 bp, Homo sapiens
cccatccgcgctctgactctc

SEQ ID NO: 7135 - DNA, 20 bp, Homo sapiens
cccatccgcgctctgactct

SEQ ID NO: 7136 - DNA, 22 bp, Homo sapiens
gtgaaggtctactgtgtgccag

SEQ ID NO: 7137 - DNA, 21 bp, Homo sapiens
ggtcgctctaggcaccgcagc

SEQ ID NO: 7138 - DNA, 18 bp, Homo sapiens
ctctgactctcttcggtg

SEQ ID NO: 7139 - DNA, 18 bp, Homo sapiens
tattacttttggtacgcg

SEQ ID NO: 7140 - DNA, 18 bp, Homo sapiens
cacagggtagaaccacgg

SEQ ID NO: 7141 - DNA, 20 bp, Homo sapiens
tgaaacaatctctactgaac

SEQ ID NO: 7142 - DNA, 18 bp, Homo sapiens
agtactgtgataactgaa

SEQ ID NO: 7143 - DNA, 21 bp, Homo sapiens
aattggaactgctgagtgaat

SEQ ID NO: 7144 - DNA, 20 bp, Homo sapiens
ccaagactgggctccccacc

SEQ ID NO: 7145 - DNA, 17 bp, Homo sapiens
gaagttgttcgtggtgg

SEQ ID NO: 7146 - DNA, 20 bp, Homo sapiens
gcactacaatgctttgctag

SEQ ID NO: 7147 - DNA, 23 bp, Homo sapiens
cattcattgctgtcggtgggttt

SEQ ID NO: 7148 - DNA, 19 bp, Homo sapiens
ccgcacggctgtcctctcc

SEQ ID NO: 7149 - DNA, 21 bp, Homo sapiens
ccatccgcgctctgactctct

SEQ ID NO: 7150 - DNA, 23 bp, Homo sapiens
ctgcagtgaaggcacttgtagca

SEQ ID NO: 7151 - DNA, 20 bp, Homo sapiens
cgtgccacccttttccccag

SEQ ID NO: 7152 - DNA, 19 bp, Homo sapiens
gtagtttcatgttgttggg

SEQ ID NO: 7153 - DNA, 23 bp, Homo sapiens
atcatagaggaaaatccacgttt

SEQ ID NO: 7154 - DNA, 21 bp, Homo sapiens
gtcggccgcgctcgaggggtc

SEQ ID NO: 7155 - DNA, 18 bp, Homo sapiens
tccccttccccgccggcc

SEQ ID NO: 7156 - DNA, 20 bp, Homo sapiens
agctggtaaaatggaaccaa

SEQ ID NO: 7157 - DNA, 16 bp, Homo sapiens
tcgtgtcttgtgttgc

SEQ ID NO: 7158 - DNA, 17 bp, Homo sapiens
tcgtgtcttgtgttgca

SEQ ID NO: 7159 - DNA, 18 bp, Homo sapiens
agctagataaccgaaagt

SEQ ID NO: 7160 - DNA, 17 bp, Homo sapiens
tctttcgggccgtagag

SEQ ID NO: 7161 - DNA, 18 bp, Homo sapiens
tctttcgggccgtagagc

SEQ ID NO: 7162 - DNA, 15 bp, Homo sapiens
tgattgtccaaacgc

SEQ ID NO: 7163 - DNA, 17 bp, Homo sapiens
cggtcgctggtacatga

SEQ ID NO: 7164 - DNA, 22 bp, Homo sapiens
gtataggcctttagatcatctg

SEQ ID NO: 7165 - DNA, 21 bp, Homo sapiens
cgcgccttccccgtcgccccg

SEQ ID NO: 7166 - DNA, 22 bp, Homo sapiens
cgcgccttccccgtcgccccgg

SEQ ID NO: 7167 - DNA, 20 bp, Homo sapiens
ctgacatacttgttccactc

SEQ ID NO: 7168 - DNA, 19 bp, Homo sapiens
tccctgggctctgcctccc

SEQ ID NO: 7169 - DNA, 22 bp, Homo sapiens
gcctccctgggctctgcctccc

SEQ ID NO: 7170 - DNA, 17 bp, Homo sapiens
ctgccctggcccgaggg

SEQ ID NO: 7171 - DNA, 22 bp, Homo sapiens
ccggacaggcgttcgtgcgacg

SEQ ID NO: 7172 - DNA, 21 bp, Homo sapiens
ccgttcggcgcgcgcgtgcgc

SEQ ID NO: 7173 - DNA, 20 bp, Homo sapiens
acgttggctctggtggtgat

SEQ ID NO: 7174 - DNA, 18 bp, Homo sapiens
atccccagatacaatgga

SEQ ID NO: 7175 - DNA, 21 bp, Homo sapiens
tgcacggcactggggacacgt

SEQ ID NO: 7176 - DNA, 22 bp, Homo sapiens
tccttgggagccctgttagact

SEQ ID NO: 7177 - DNA, 29 bp, Homo sapiens
aaaccgttaccattactgagtttagtaat

SEQ ID NO: 7178 - DNA, 22 bp, Homo sapiens
gctacaacacaggacccgggcg

SEQ ID NO: 7179 - DNA, 21 bp, Homo sapiens
taggcagtgtattgctagcgg

SEQ ID NO: 7180 - DNA, 22 bp, Homo sapiens
gtacttcacctggtccactagc

SEQ ID NO: 7181 - DNA, 20 bp, Homo sapiens
ctgccagttgaagaactgtt

SEQ ID NO: 7182 - DNA, 18 bp, Homo sapiens
gaacgtcgagactggagc

SEQ ID NO: 7183 - DNA, 20 bp, Homo sapiens
gccgcacggctgtcctctcc

SEQ ID NO: 7184 - DNA, 30 bp, Homo sapiens
tttgaaaaaaccactgaccgttgactgtac

SEQ ID NO: 7185 - DNA, 23 bp, Homo sapiens
tgaagctcagagggctctgattc

SEQ ID NO: 7186 - DNA, 21 bp, Homo sapiens
ccagtggagatgctgttactt

SEQ ID NO: 7187 - DNA, 21 bp, Homo sapiens
tccctttgtcatccttcgcct

SEQ ID NO: 7188 - DNA, 16 bp, Homo sapiens
ctgccgggtaatgatg

SEQ ID NO: 7189 - DNA, 21 bp, Homo sapiens
aatccggtgcacattgtaggc

SEQ ID NO: 7190 - DNA, 22 bp, Homo sapiens
tataggcctttagatcatctga

SEQ ID NO: 7191 - DNA, 22 bp, Homo sapiens
ctctgtcggccggccctgggtc

SEQ ID NO: 7192 - DNA, 23 bp, Homo sapiens
aagtgcttcgattttggggtgtc

SEQ ID NO: 7193 - DNA, 23 bp, Homo sapiens
gggacgcgggcctggacgccggc

SEQ ID NO: 7194 - DNA, 17 bp, Homo sapiens
catccccgactggaagc

SEQ ID NO: 7195 - DNA, 18 bp, Homo sapiens
gtcaggcggctcggactg

SEQ ID NO: 7196 - DNA, 15 bp, Homo sapiens
taacagtctacagcc

SEQ ID NO: 7197 - DNA, 20 bp, Homo sapiens
tccctttgtcatccttcgcc

SEQ ID NO: 7198 - DNA, 18 bp, Homo sapiens
atgacacgatcactcccg

SEQ ID NO: 7199 - DNA, 18 bp, Homo sapiens
aaggcacgcggtgaatgc

SEQ ID NO: 7200 - DNA, 22 bp, Homo sapiens
atccttggaacctaggtgtgag

SEQ ID NO: 7201 - DNA, 19 bp, Homo sapiens
tgatgtttgacccttgagc

SEQ ID NO: 7202 - DNA, 21 bp, Homo sapiens
agcaccaggatattgttggag

SEQ ID NO: 7203 - DNA, 21 bp, Homo sapiens
tgtcctgcttgtcctgcgagg

SEQ ID NO: 7204 - DNA, 17 bp, Homo sapiens
aggcaagatgctggcat

SEQ ID NO: 7205 - DNA, 19 bp, Homo sapiens
agctgggttgagagggcga

SEQ ID NO: 7206 - DNA, 18 bp, Homo sapiens
ggttgtgtcagtgtcaga

SEQ ID NO: 7207 - DNA, 22 bp, Homo sapiens
ttgggcgtatctgtatgctagg

SEQ ID NO: 7208 - DNA, 22 bp, Homo sapiens
gacgttggctctggtggtgatg

SEQ ID NO: 7209 - DNA, 21 bp, Homo sapiens
ctagcacacagatacgcccag

SEQ ID NO: 7210 - DNA, 20 bp, Homo sapiens
ggggaccggccgcgactgcg

SEQ ID NO: 7211 - DNA, 21 bp, Homo sapiens
ggggaccggccgcgactgcgg

SEQ ID NO: 7212 - DNA, 21 bp, Homo sapiens
gtccccttccccgccggccgc

SEQ ID NO: 7213 - DNA, 26 bp, Homo sapiens
tggtgggccgcagaacatgtgctgag

SEQ ID NO: 7214 - DNA, 25 bp, Homo sapiens
tggtgggccgcagaacatgtgctga

SEQ ID NO: 7215 - DNA, 22 bp, Homo sapiens
tttttgcggtctgggcttgctg

SEQ ID NO: 7216 - DNA, 18 bp, Homo sapiens
acattgtctgctgggttt

SEQ ID NO: 7217 - DNA, 21 bp, Homo sapiens
gcggggatcgccgagggccgg

SEQ ID NO: 7218 - DNA, 24 bp, Homo sapiens
gagtcatacacggctctcctctct

SEQ ID NO: 7219 - DNA, 22 bp, Homo sapiens
gcagccacaactaccctgccac

SEQ ID NO: 7220 - DNA, 19 bp, Homo sapiens
gagtgtgacaatggtgttt

SEQ ID NO: 7221 - DNA, 20 bp, Homo sapiens
gcgccgcgggaccgccctcg

SEQ ID NO: 7222 - DNA, 18 bp, Homo sapiens
tgtagaaccgaatttgtg

SEQ ID NO: 7223 - DNA, 18 bp, Homo sapiens
gggcgccgcgggaccgcc

SEQ ID NO: 7224 - DNA, 20 bp, Homo sapiens
agaagatctcaggcagtgac

SEQ ID NO: 7225 - DNA, 20 bp, Homo sapiens
gtgctgcgacatttgagcgt

SEQ ID NO: 7226 - DNA, 22 bp, Homo sapiens
tggtggtttacaaagtaattca

SEQ ID NO: 7227 - DNA, 20 bp, Homo sapiens
cttagcaggttgtattatca

SEQ ID NO: 7228 - DNA, 20 bp, Homo sapiens
tgctgttgacagtgagcgac

SEQ ID NO: 7229 - DNA, 19 bp, Homo sapiens
gtatgtgcctttggactac

SEQ ID NO: 7230 - DNA, 21 bp, Homo sapiens
gtatgtgcctttggactacat

SEQ ID NO: 7231 - DNA, 21 bp, Homo sapiens
aaaacgtgaggcgctgctata

SEQ ID NO: 7232 - DNA, 18 bp, Homo sapiens
atatctcaggctgtgacc

SEQ ID NO: 7233 - DNA, 19 bp, Homo sapiens
tccggttctcagggctcca

SEQ ID NO: 7234 - DNA, 19 bp, Homo sapiens
tcacacagaaatcgcaccc

SEQ ID NO: 7235 - DNA, 21 bp, Homo sapiens
ctcactcctctcctcccgtct

SEQ ID NO: 7236 - DNA, 23 bp, Homo sapiens
gtggccctgactgaagaccagca

SEQ ID NO: 7237 - DNA, 21 bp, Homo sapiens
aagcccttaccccaaaaagta

SEQ ID NO: 7238 - DNA, 18 bp, Homo sapiens
tttggtccccttcaacca

SEQ ID NO: 7239 - DNA, 25 bp, Homo sapiens
tgagaactgaattccatgggttgtg

SEQ ID NO: 7240 - DNA, 30 bp, Homo sapiens
ggccgcgctcgaggggtccccgtggcgtcc

SEQ ID NO: 7241 - DNA, 18 bp, Homo sapiens
atagaggctgtggctgga

SEQ ID NO: 7242 - DNA, 20 bp, Homo sapiens
tccttgggagccctgttaga

SEQ ID NO: 7243 - DNA, 18 bp, Homo sapiens
gtacagtactgtgataac

SEQ ID NO: 7244 - DNA, 18 bp, Homo sapiens
ttcagtcggatgtttaca

SEQ ID NO: 7245 - DNA, 20 bp, Homo sapiens
tgtttcctactttatggatg

SEQ ID NO: 7246 - DNA, 20 bp, Homo sapiens
gacgggaggaaagaagggag

SEQ ID NO: 7247 - DNA, 21 bp, Homo sapiens
agaagatctcatgctgtgact

SEQ ID NO: 7248 - DNA, 21 bp, Homo sapiens
aatggtagaactcacactggt

SEQ ID NO: 7249 - DNA, 22 bp, Homo sapiens
tatacgacctgctgcctttctt

SEQ ID NO: 7250 - DNA, 22 bp, Homo sapiens
tgccctaaatgccccttctggc

SEQ ID NO: 7251 - DNA, 20 bp, Homo sapiens
ggtgggatcccgcggccgtg

SEQ ID NO: 7252 - DNA, 19 bp, Homo sapiens
gtgggatcccgcggccgtg

SEQ ID NO: 7253 - DNA, 24 bp, Homo sapiens
tgtagtgtttcctactttatggat

SEQ ID NO: 7254 - DNA, 20 bp, Homo sapiens
aaagctgggttgagagggca

SEQ ID NO: 7255 - DNA, 22 bp, Homo sapiens
agatgaagcactgtagctcagg

SEQ ID NO: 7256 - DNA, 21 bp, Homo sapiens
tccccttccccgccggccgcc

SEQ ID NO: 7257 - DNA, 19 bp, Homo sapiens
tccccttccccgccggccg

SEQ ID NO: 7258 - DNA, 20 bp, Homo sapiens
tccccttccccgccggccgc

SEQ ID NO: 7259 - DNA, 20 bp, Homo sapiens
gacgttggctctggtggtga

SEQ ID NO: 7260 - DNA, 19 bp, Homo sapiens
aaggccgggcctggcgggg

SEQ ID NO: 7261 - DNA, 22 bp, Homo sapiens
ccaaaccacactgtggtgttag

SEQ ID NO: 7262 - DNA, 20 bp, Homo sapiens
ggacggagaactgataaggg

SEQ ID NO: 7263 - DNA, 28 bp, Homo sapiens
ttcaagtaatccaggataggctgtgcag

SEQ ID NO: 7264 - DNA, 19 bp, Homo sapiens
cagatcagaaggtgattgt

SEQ ID NO: 7265 - DNA, 18 bp, Homo sapiens
gtcggccggccctgggtc

SEQ ID NO: 7266 - DNA, 18 bp, Homo sapiens
agctcggtctgaggcccc

SEQ ID NO: 7267 - DNA, 21 bp, Homo sapiens
gaacattcaacgctgtcggtg

SEQ ID NO: 7268 - DNA, 19 bp, Homo sapiens
tggtccccttcaaccagct

SEQ ID NO: 7269 - DNA, 20 bp, Homo sapiens
gtggcgtccccttccccgcc

SEQ ID NO: 7270 - DNA, 22 bp, Homo sapiens
cctctagaggaagcactttctg

SEQ ID NO: 7271 - DNA, 17 bp, Homo sapiens
tttccggctcgcgtggg

SEQ ID NO: 7272 - DNA, 18 bp, Homo sapiens
ggtacgtctgtgggtaga

SEQ ID NO: 7273 - DNA, 19 bp, Homo sapiens
ccacagggtagaaccacgg

SEQ ID NO: 7274 - DNA, 22 bp, Homo sapiens
aggcctattcttgattacttgt

SEQ ID NO: 7275 - DNA, 20 bp, Homo sapiens
cagccacaactaccctgcca

SEQ ID NO: 7276 - DNA, 22 bp, Homo sapiens
aggcagcggggtgtagtggata

SEQ ID NO: 7277 - DNA, 25 bp, Homo sapiens
ggaatctgtgctctgggggctgtgc

SEQ ID NO: 7278 - DNA, 21 bp, Homo sapiens
ttgcacttgtctcggtctgac

SEQ ID NO: 7279 - DNA, 22 bp, Homo sapiens
ttgcacttgtctcggtctgaca

SEQ ID NO: 7280 - DNA, 19 bp, Homo sapiens
caacctggaggactccatg

SEQ ID NO: 7281 - DNA, 20 bp, Homo sapiens
caacctggaggactccatgc

SEQ ID NO: 7282 - DNA, 19 bp, Homo sapiens
agggggaaagttctatagt

SEQ ID NO: 7283 - DNA, 21 bp, Homo sapiens
gggggccgatacactgtacga

SEQ ID NO: 7284 - DNA, 23 bp, Homo sapiens
agttggcatggctcagtccaagt

SEQ ID NO: 7285 - DNA, 22 bp, Homo sapiens
gaggtagtaggttgcatagttt

SEQ ID NO: 7286 - DNA, 21 bp, Homo sapiens
actcaaaaagctgtcagtcac

SEQ ID NO: 7287 - DNA, 25 bp, Homo sapiens
gagcctggaagctggagcctgcagt

SEQ ID NO: 7288 - DNA, 21 bp, Homo sapiens
tcctcccatgccaagaactcc

SEQ ID NO: 7289 - DNA, 17 bp, Homo sapiens
cttttcattcctatgtg

SEQ ID NO: 7290 - DNA, 22 bp, Homo sapiens
tatcagaatctccaggggtact

SEQ ID NO: 7291 - DNA, 24 bp, Homo sapiens
ggtccagttttcccaggaatccct

SEQ ID NO: 7292 - DNA, 24 bp, Homo sapiens
gaacattcaacgctgtcggtgagt

SEQ ID NO: 7293 - DNA, 18 bp, Homo sapiens
ggtgggatcccgcggccg

SEQ ID NO: 7294 - DNA, 18 bp, Homo sapiens
gcacggtatccatctgta

SEQ ID NO: 7295 - DNA, 20 bp, Homo sapiens
atcagggcttgtggaatggg

SEQ ID NO: 7296 - DNA, 22 bp, Homo sapiens
caatcatgtgcagtgccaatat

SEQ ID NO: 7297 - DNA, 20 bp, Homo sapiens
caatcatgtgcagtgccaat

SEQ ID NO: 7298 - DNA, 23 bp, Homo sapiens
ctcaaactgtgggggcactttct

SEQ ID NO: 7299 - DNA, 19 bp, Homo sapiens
tcatacacggttgacctat

SEQ ID NO: 7300 - DNA, 22 bp, Homo sapiens
agcctggaagctggagcctgca

SEQ ID NO: 7301 - DNA, 21 bp, Homo sapiens
ttgcacggtatccatctgtaa

SEQ ID NO: 7302 - DNA, 18 bp, Homo sapiens
cgaggggtccccgtggcg

SEQ ID NO: 7303 - DNA, 18 bp, Homo sapiens
cagtgacctgaatcaggt

SEQ ID NO: 7304 - DNA, 22 bp, Homo sapiens
tttaactttgatggcaaagggg

SEQ ID NO: 7305 - DNA, 21 bp, Homo sapiens
atggcgccactagggttgtgc

SEQ ID NO: 7306 - DNA, 21 bp, Homo sapiens
aggaccttccctgaaccaagg

SEQ ID NO: 7307 - DNA, 18 bp, Homo sapiens
tggagagaaaggcagtag

SEQ ID NO: 7308 - DNA, 17 bp, Homo sapiens
gtgacaatggtgtttgt

SEQ ID NO: 7309 - DNA, 18 bp, Homo sapiens
actgctagctgtagaact

SEQ ID NO: 7310 - DNA, 21 bp, Homo sapiens
ggtggggcaatgggatcaggt

SEQ ID NO: 7311 - DNA, 22 bp, Homo sapiens
cggatccgtctgagcttggctg

SEQ ID NO: 7312 - DNA, 24 bp, Homo sapiens
cgtgctgatgtttgacccttgagc

SEQ ID NO: 7313 - DNA, 19 bp, Homo sapiens
cccggtcgctggtacatga

SEQ ID NO: 7314 - DNA, 20 bp, Homo sapiens
ccccgttcggcgcgcgcgtg

SEQ ID NO: 7315 - DNA, 22 bp, Homo sapiens
cgtggcgtccccttccccgccg

SEQ ID NO: 7316 - DNA, 19 bp, Homo sapiens
ctgagaccctttaacctgt

SEQ ID NO: 7317 - DNA, 23 bp, Homo sapiens
aatcatacacggttgacctattt

SEQ ID NO: 7318 - DNA, 20 bp, Homo sapiens
tacaagggcaagctctctgt

SEQ ID NO: 7319 - DNA, 21 bp, Homo sapiens
ctcggggatcatcatgtcacg

SEQ ID NO: 7320 - DNA, 19 bp, Homo sapiens
ccccagggcgacgcggcgg

SEQ ID NO: 7321 - DNA, 18 bp, Homo sapiens
cctatgaattgacagaca

SEQ ID NO: 7322 - DNA, 23 bp, Homo sapiens
cggatccgtctgagcttggctgg

SEQ ID NO: 7323 - DNA, 19 bp, Homo sapiens
agctggtaaaatggaacca

SEQ ID NO: 7324 - DNA, 21 bp, Homo sapiens
ttgcacttgtcccggcctgtg

SEQ ID NO: 7325 - DNA, 19 bp, Homo sapiens
tgatatgtttgatattggg

SEQ ID NO: 7326 - DNA, 20 bp, Homo sapiens
ctgtaaacgctttctgatgt

SEQ ID NO: 7327 - DNA, 21 bp, Homo sapiens
taatccttgctacctgggtga

SEQ ID NO: 7328 - DNA, 18 bp, Homo sapiens
ctcaaactgtgggggcac

SEQ ID NO: 7329 - DNA, 22 bp, Homo sapiens
tactcaaaatgggggcgctttc

SEQ ID NO: 7330 - DNA, 19 bp, Homo sapiens
catgttgtctgtggtaccc

SEQ ID NO: 7331 - DNA, 20 bp, Homo sapiens
atgcacctgggcaaggattc

SEQ ID NO: 7332 - DNA, 19 bp, Homo sapiens
tatacctcagttttatcag

SEQ ID NO: 7333 - DNA, 20 bp, Homo sapiens
tagataaaatattggtacct

SEQ ID NO: 7334 - DNA, 18 bp, Homo sapiens
aagatctcaggctgtcgt

SEQ ID NO: 7335 - DNA, 16 bp, Homo sapiens
tcgaccggacctcgac

SEQ ID NO: 7336 - DNA, 21 bp, Homo sapiens
cctggtacaggcctgggggac

SEQ ID NO: 7337 - DNA, 22 bp, Homo sapiens
aaagctgggttgagagggcaaa

SEQ ID NO: 7338 - DNA, 22 bp, Homo sapiens
aaagctagataaccgaaagtaa

SEQ ID NO: 7339 - DNA, 22 bp, Homo sapiens
cgcggggatcgccgagggccgg

SEQ ID NO: 7340 - DNA, 20 bp, Homo sapiens
actgccctaagtgctccttc

SEQ ID NO: 7341 - DNA, 24 bp, Homo sapiens
tggcgtccccttccccgccggccg

SEQ ID NO: 7342 - DNA, 19 bp, Homo sapiens
aagtgcttatagtgcaggt

SEQ ID NO: 7343 - DNA, 21 bp, Homo sapiens
tgggcgtatctgtatgctagg

SEQ ID NO: 7344 - DNA, 19 bp, Homo sapiens
gtgcttacagtgcaggtag

SEQ ID NO: 7345 - DNA, 23 bp, Homo sapiens
cgagcctcaagcaagggacttca

SEQ ID NO: 7346 - DNA, 24 bp, Homo sapiens
actgccctaaatgccccttctggc

SEQ ID NO: 7347 - DNA, 16 bp, Homo sapiens
tgtaaacatcctcgac

SEQ ID NO: 7348 - DNA, 19 bp, Homo sapiens
aaatgctcagactcctgtg

SEQ ID NO: 7349 - DNA, 21 bp, Homo sapiens
ggagcttacaatctagctggg

SEQ ID NO: 7350 - DNA, 18 bp, Homo sapiens
ttcaagtaattcaggata

SEQ ID NO: 7351 - DNA, 20 bp, Homo sapiens
aattgcactttagcaatggt

SEQ ID NO: 7352 - DNA, 22 bp, Homo sapiens
tcacctgacctcccatgcctgt

SEQ ID NO: 7353 - DNA, 20 bp, Homo sapiens
ctgcagtgaaggcacttgta

SEQ ID NO: 7354 - DNA, 22 bp, Homo sapiens
ctgtagtatgggcacttccagt

SEQ ID NO: 7355 - DNA, 21 bp, Homo sapiens
gttcacagtggctaagttccg

SEQ ID NO: 7356 - DNA, 20 bp, Homo sapiens
attatggtttgcctgggact

SEQ ID NO: 7357 - DNA, 21 bp, Homo sapiens
attatggtttgcctgggactg

SEQ ID NO: 7358 - DNA, 24 bp, Homo sapiens
accactgaccgttgactgtacctt

SEQ ID NO: 7359 - DNA, 20 bp, Homo sapiens
acctggacccagcgtagaca

SEQ ID NO: 7360 - DNA, 21 bp, Homo sapiens
caccctgcatcccgcacccag

SEQ ID NO: 7361 - DNA, 19 bp, Homo sapiens
gcacgtaaatattggcgta

SEQ ID NO: 7362 - DNA, 24 bp, Homo sapiens
gcaagaatatctcaggctgtgacc

SEQ ID NO: 7363 - DNA, 20 bp, Homo sapiens
ggggtgctatctgtgattga

SEQ ID NO: 7364 - DNA, 23 bp, Homo sapiens
gggtggggatttgttgcattact

SEQ ID NO: 7365 - DNA, 24 bp, Homo sapiens
ttctcaaggaggtgtcgtttatgt

SEQ ID NO: 7366 - DNA, 20 bp, Homo sapiens
gagaactgaattccataggc

SEQ ID NO: 7367 - DNA, 17 bp, Homo sapiens
cacttgtctcggtctga

SEQ ID NO: 7368 - DNA, 23 bp, Homo sapiens
ctaggcagtgtagttagctgatt

SEQ ID NO: 7369 - DNA, 20 bp, Homo sapiens
agggttgggtggaggctctc

SEQ ID NO: 7370 - DNA, 19 bp, Homo sapiens
tactcagaaaggtgccagt

SEQ ID NO: 7371 - DNA, 18 bp, Homo sapiens
ctctacagggaagcgctt

SEQ ID NO: 7372 - DNA, 19 bp, Homo sapiens
gggatcgccgagggccggt

SEQ ID NO: 7373 - DNA, 20 bp, Homo sapiens
gggatcgccgagggccggtc

SEQ ID NO: 7374 - DNA, 21 bp, Homo sapiens
gcgtccccttccccgccggcc

SEQ ID NO: 7375 - DNA, 22 bp, Homo sapiens
caaaagtgatcgtggtttttgc

SEQ ID NO: 7376 - DNA, 22 bp, Homo sapiens
cctggtacaggcctgggggaca

SEQ ID NO: 7377 - DNA, 19 bp, Homo sapiens
atattgcactcgtcccggc

SEQ ID NO: 7378 - DNA, 19 bp, Homo sapiens
gcattgtacagggctatca

SEQ ID NO: 7379 - DNA, 20 bp, Homo sapiens
gaggcagaagcaggatgaca

SEQ ID NO: 7380 - DNA, 20 bp, Homo sapiens
caaaacgtgaggcgctgcta

SEQ ID NO: 7381 - DNA, 20 bp, Homo sapiens
tttgaggccttaaagtactg

SEQ ID NO: 7382 - DNA, 20 bp, Homo sapiens
gcaacaccagtcgatgggct

SEQ ID NO: 7383 - DNA, 21 bp, Homo sapiens
tacttcacctggtccactagc

SEQ ID NO: 7384 - DNA, 17 bp, Homo sapiens
cgtgtgtgaggcgggtg

SEQ ID NO: 7385 - DNA, 21 bp, Homo sapiens
caaaaaccacagtttcttttg

SEQ ID NO: 7386 - DNA, 17 bp, Homo sapiens
ccgggtgccgcgcggtg

SEQ ID NO: 7387 - DNA, 16 bp, Homo sapiens
attgcacttgtcccgg

SEQ ID NO: 7388 - DNA, 19 bp, Homo sapiens
agtgccgccatcttttgag

SEQ ID NO: 7389 - DNA, 20 bp, Homo sapiens
tggttttgtttgggtttgtt

SEQ ID NO: 7390 - DNA, 18 bp, Homo sapiens
accacagggtagaaccac

SEQ ID NO: 7391 - DNA, 19 bp, Homo sapiens
ccatagaggctgtggctgg

SEQ ID NO: 7392 - DNA, 21 bp, Homo sapiens
ccgatttctcctggtgttcag

SEQ ID NO: 7393 - DNA, 19 bp, Homo sapiens
ctcaaaaagctgtcagtca

SEQ ID NO: 7394 - DNA, 23 bp, Homo sapiens
tagccttcagatcttggtgtttt

SEQ ID NO: 7395 - DNA, 23 bp, Homo sapiens
tcgtaccgtgagtaataatgcgc

SEQ ID NO: 7396 - DNA, 17 bp, Homo sapiens
catcctacactctcagc

SEQ ID NO: 7397 - DNA, 18 bp, Homo sapiens
tcgactgtccaatggatt

SEQ ID NO: 7398 - DNA, 21 bp, Homo sapiens
atgaggtagtagattgtatag

SEQ ID NO: 7399 - DNA, 20 bp, Homo sapiens
tataatacaacctgctaagt

SEQ ID NO: 7400 - DNA, 20 bp, Homo sapiens
tacattgtctgctgggtttc

SEQ ID NO: 7401 - DNA, 20 bp, Homo sapiens
ttacccagtctccggtgcag

SEQ ID NO: 7402 - DNA, 23 bp, Homo sapiens
ccgtggcgtccccttccccgccg

SEQ ID NO: 7403 - DNA, 17 bp, Homo sapiens
aatgcacccgggcaagg

SEQ ID NO: 7404 - DNA, 19 bp, Homo sapiens
aatgcacccgggcaaggat

SEQ ID NO: 7405 - DNA, 21 bp, Homo sapiens
aaaggaggcgccggctgtggc

SEQ ID NO: 7406 - DNA, 20 bp, Homo sapiens
ctcccggacaggcgttcgtg

SEQ ID NO: 7407 - DNA, 22 bp, Homo sapiens
tagtggatgatgcactctgtgc

SEQ ID NO: 7408 - DNA, 17 bp, Homo sapiens
tggcactggtagaattc

SEQ ID NO: 7409 - DNA, 21 bp, Homo sapiens
gaaagtgcttctctttggtgg

SEQ ID NO: 7410 - DNA, 17 bp, Homo sapiens
tctggctccgtgtcttc

SEQ ID NO: 7411 - DNA, 20 bp, Homo sapiens
tacccagtctccggtgcagc

SEQ ID NO: 7412 - DNA, 19 bp, Homo sapiens
gtagtagtttgtgctgttg

SEQ ID NO: 7413 - DNA, 21 bp, Homo sapiens
actcactgatcaatgaatgca

SEQ ID NO: 7414 - DNA, 20 bp, Homo sapiens
acagcaggcacagacaggca

SEQ ID NO: 7415 - DNA, 22 bp, Homo sapiens
ttcaagccagggggcgtttttc

SEQ ID NO: 7416 - DNA, 20 bp, Homo sapiens
gagtgtgacaatggtgtttg

SEQ ID NO: 7417 - DNA, 26 bp, Homo sapiens
agctacatctggctactgggtctctg

SEQ ID NO: 7418 - DNA, 22 bp, Homo sapiens
aggactccatttgttttgatga

SEQ ID NO: 7419 - DNA, 22 bp, Homo sapiens
acctggcatacaatgtagattt

SEQ ID NO: 7420 - DNA, 20 bp, Homo sapiens
cctcaaatgtggagcactat

SEQ ID NO: 7421 - DNA, 21 bp, Homo sapiens
tagaggagatggcgcagggga

SEQ ID NO: 7422 - DNA, 16 bp, Homo sapiens
ctcttgagggaagcac

SEQ ID NO: 7423 - DNA, 18 bp, Homo sapiens
cggaatcccaaaagcagc

SEQ ID NO: 7424 - DNA, 17 bp, Homo sapiens
tacattgtctgctgggt

SEQ ID NO: 7425 - DNA, 18 bp, Homo sapiens
tacattgtctgctgggtt

SEQ ID NO: 7426 - DNA, 23 bp, Homo sapiens
ctgtacagcctcctagctttcct

SEQ ID NO: 7427 - DNA, 22 bp, Homo sapiens
ggcaatggtagaactcacactg

SEQ ID NO: 7428 - DNA, 21 bp, Homo sapiens
ctctgactttattgcactact

SEQ ID NO: 7429 - DNA, 22 bp, Homo sapiens
cactgacaggagagcattttga

SEQ ID NO: 7430 - DNA, 22 bp, Homo sapiens
actggacttggagtcagaagag

SEQ ID NO: 7431 - DNA, 17 bp, Homo sapiens
actgccgggtaatgatg

SEQ ID NO: 7432 - DNA, 23 bp, Homo sapiens
atgattggtacgtctgtgggtag

SEQ ID NO: 7433 - DNA, 19 bp, Homo sapiens
cccccaggtgtgattctga

SEQ ID NO: 7434 - DNA, 21 bp, Homo sapiens
gtatgtgggatggtaaaccgc

SEQ ID NO: 7435 - DNA, 22 bp, Homo sapiens
agggactttcaggggcagctgt

SEQ ID NO: 7436 - DNA, 19 bp, Homo sapiens
tagtagaccgtatagcgta

SEQ ID NO: 7437 - DNA, 18 bp, Homo sapiens
cagtgaaggcacttgtag

SEQ ID NO: 7438 - DNA, 18 bp, Homo sapiens
tttcaagccagggggcgt

SEQ ID NO: 7439 - DNA, 17 bp, Homo sapiens
gcacccttctgagtaga

SEQ ID NO: 7440 - DNA, 19 bp, Homo sapiens
ccctgtgccacggccggct

SEQ ID NO: 7441 - DNA, 19 bp, Homo sapiens
agtgtgacaatggtgtttg

SEQ ID NO: 7442 - DNA, 20 bp, Homo sapiens
gaagctcagagggctctgat

SEQ ID NO: 7443 - DNA, 21 bp, Homo sapiens
cgggaggaaagaagggagtgg

SEQ ID NO: 7444 - DNA, 22 bp, Homo sapiens
agggttgggtggaggctctcct

SEQ ID NO: 7445 - DNA, 20 bp, Homo sapiens
ctatagaactttccccctca

SEQ ID NO: 7446 - DNA, 21 bp, Homo sapiens
aggttgggatcggttgcaatg

SEQ ID NO: 7447 - DNA, 23 bp, Homo sapiens
aagctacagttacttttgcacca

SEQ ID NO: 7448 - DNA, 19 bp, Homo sapiens
tatacaagggcaagctctc

SEQ ID NO: 7449 - DNA, 18 bp, Homo sapiens
attggtacgtctgtgggt

SEQ ID NO: 7450 - DNA, 17 bp, Homo sapiens
tgccgggtaatgatgga

SEQ ID NO: 7451 - DNA, 18 bp, Homo sapiens
cacgctcatgcacacacc

SEQ ID NO: 7452 - DNA, 20 bp, Homo sapiens
ccccagggcgacgcggcggg

SEQ ID NO: 7453 - DNA, 24 bp, Homo sapiens
atgattggtacgtctgtgggtaga

SEQ ID NO: 7454 - DNA, 20 bp, Homo sapiens
acctgccgcgccccccgggc

SEQ ID NO: 7455 - DNA, 23 bp, Homo sapiens
cctcaaatgtggagcactattct

SEQ ID NO: 7456 - DNA, 23 bp, Homo sapiens
tggtcaggcggctcggactgagc

SEQ ID NO: 7457 - DNA, 19 bp, Homo sapiens
attgtagccttttggagta

SEQ ID NO: 7458 - DNA, 19 bp, Homo sapiens
tcaacacttgctggtttcc

SEQ ID NO: 7459 - DNA, 21 bp, Homo sapiens
tgaaacaatctctactgaacc

SEQ ID NO: 7460 - DNA, 19 bp, Homo sapiens
taccacagggtagaaccac

SEQ ID NO: 7461 - DNA, 17 bp, Homo sapiens
gcttatagtgcaggtag

SEQ ID NO: 7462 - DNA, 19 bp, Homo sapiens
tccgcgctctgactctctg

SEQ ID NO: 7463 - DNA, 19 bp, Homo sapiens
tgagtattacatggccaat

SEQ ID NO: 7464 - DNA, 22 bp, Homo sapiens
tagtagaccgtatagcgtacgc

SEQ ID NO: 7465 - DNA, 21 bp, Homo sapiens
aggtgcagtgctgcatctctg

SEQ ID NO: 7466 - DNA, 21 bp, Homo sapiens
gtttgataagctgacatggga

SEQ ID NO: 7467 - DNA, 27 bp, Homo sapiens
tgtccttcattccaccggagtctgtct

SEQ ID NO: 7468 - DNA, 28 bp, Homo sapiens
tccatcttccagtacagtgttggatggt

SEQ ID NO: 7469 - DNA, 23 bp, Homo sapiens
cgtcttacccagcagtgtttggg

SEQ ID NO: 7470 - DNA, 23 bp, Homo sapiens
gaaattattgtacatcggatgag

SEQ ID NO: 7471 - DNA, 27 bp, Homo sapiens
catcttaccggacagtgctggatttcc

SEQ ID NO: 7472 - DNA, 25 bp, Homo sapiens
ttaggtagtttcatgttgttgggmt

SEQ ID NO: 7473 - DNA, 24 bp, Homo sapiens
acagattcgattctaggggaatat

SEQ ID NO: 7474 - DNA, 24 bp, Homo sapiens
ggctgccaattccataggtcacag

SEQ ID NO: 7475 - DNA, 23 bp, Homo sapiens
ccagtggggctgctgttatctgg

SEQ ID NO: 7476 - DNA, 24 bp, Homo sapiens
tatggcttttcattcctatgtgat

SEQ ID NO: 7477 - DNA, 23 bp, Homo sapiens
catcttactgggcagcattggat

SEQ ID NO: 7478 - DNA, 25 bp, Homo sapiens
cttccctttgtcatcctwygcctrr

SEQ ID NO: 7479 - DNA, 24 bp, Homo sapiens
tctggctccgtgtcttcactcccg

SEQ ID NO: 7480 - DNA, 23 bp, Homo sapiens
tccattacactaccctgcctctt

SEQ ID NO: 7481 - DNA, 24 bp, Homo sapiens
tatggctttttattcctatgtgat

SEQ ID NO: 7482 - DNA, 24 bp, Homo sapiens
taaggtgcatctagtgcagwtagt

SEQ ID NO: 7483 - DNA, 24 bp, Homo sapiens
aattgcacggtatccatctgtaaa

SEQ ID NO: 7484 - DNA, 25 bp, Homo sapiens
atggaatgtaaagaagtatgtatyt

SEQ ID NO: 7485 - DNA, 25 bp, Homo sapiens
atggaatgtaaggaagtgtgtggtt

SEQ ID NO: 7486 - DNA, 25 bp, Homo sapiens
tttggtccccttcaaccagctryag

SEQ ID NO: 7487 - DNA, 22 bp, Homo sapiens
atgctgacatatttactagagg

SEQ ID NO: 7488 - DNA, 25 bp, Homo sapiens
ctaatactgcctggtaatgatgacg

SEQ ID NO: 7489 - DNA, 28 bp, Homo sapiens
catgatactgtaaacgctttctgatgta

SEQ ID NO: 7490 - DNA, 26 bp, Homo sapiens
accccgggaacgtcgagactggagcg

SEQ ID NO: 7491 - DNA, 24 bp, Homo sapiens
ctttttgcggtctgggcttgctgt

SEQ ID NO: 7492 - DNA, 26 bp, Homo sapiens
cttgcaacgaacctgagccactgatt

SEQ ID NO: 7493 - DNA, 25 bp, Homo sapiens
tggagtgtgacaatggtgtttgtgt

SEQ ID NO: 7494 - DNA, 26 bp, Homo sapiens
agggcttagctgcttgtgagcagggt

SEQ ID NO: 7495 - DNA, 25 bp, Homo sapiens
tgaccgatttctcctggtgttcaga

SEQ ID NO: 7496 - DNA, 22 bp, Homo sapiens
tttccggctcgcgtgggtgtgt

SEQ ID NO: 7497 - DNA, 27 bp, Homo sapiens
atcacaagtcaggctcttgggacctag

SEQ ID NO: 7498 - DNA, 22 bp, Homo sapiens
ctgtatgccctcaccgctcagc

SEQ ID NO: 7499 - DNA, 23 bp, Homo sapiens
gtagataaaatattggtacctga

SEQ ID NO: 7500 - DNA, 28 bp, Homo sapiens
caaagttctgagacactccgactctgag

SEQ ID NO: 7501 - DNA, 25 bp, Homo sapiens
caagtcactagtggttccgtttagt

SEQ ID NO: 7502 - DNA, 25 bp, Homo sapiens
ctcgtgtcttgtgttgcagccggag

SEQ ID NO: 7503 - DNA, 24 bp, Homo sapiens
tcagcaccaggatattgttggaga

SEQ ID NO: 7504 - DNA, 25 bp, Homo sapiens
attgtgtcaatatgcgatgatgtgt

SEQ ID NO: 7505 - DNA, 23 bp, Homo sapiens
ctgtacaaccttctagctttcct

SEQ ID NO: 7506 - DNA, 24 bp, Homo sapiens
ggattcctggaaatactgttcttg

SEQ ID NO: 7507 - DNA, 23 bp, Homo sapiens
ttgtttaaccttttgcctgttgg

SEQ ID NO: 7508 - DNA, 24 bp, Homo sapiens
cctggactgagccgtgctactggc

SEQ ID NO: 7509 - DNA, 23 bp, Homo sapiens
cacccgtcccgttcgtccccgga

SEQ ID NO: 7510 - DNA, 25 bp, Homo sapiens
cagagcttagctgattggtgaacag

SEQ ID NO: 7511 - DNA, 22 bp, Homo sapiens
ttgaaacaatctctactgaacc

SEQ ID NO: 7512 - DNA, 25 bp, Homo sapiens
taggtagtttcctgttgttgggatc

SEQ ID NO: 7513 - DNA, 25 bp, Homo sapiens
acccagtgtttagactatctgttca

SEQ ID NO: 7514 - DNA, 23 bp, Homo sapiens
ctaatactgtctggtaaaaccgt

SEQ ID NO: 7515 - DNA, 25 bp, Homo sapiens
ctaacactgtctggtaamgatgkyy

SEQ ID NO: 7516 - DNA, 26 bp, Homo sapiens
atgattgtagccttttggagtagagt

SEQ ID NO: 7517 - DNA, 22 bp, Homo sapiens
ctcactgaacaatgaatgcaac

SEQ ID NO: 7518 - DNA, 23 bp, Homo sapiens
gtcatttttgtgatgttgcagct

SEQ ID NO: 7519 - DNA, 23 bp, Homo sapiens
agttttgcaggtttgcatccagc

SEQ ID NO: 7520 - DNA, 23 bp, Homo sapiens
cactggacttggagtcagaagag

SEQ ID NO: 7521 - DNA, 23 bp, Homo sapiens
tgcctgtctacacttgctgtgca

SEQ ID NO: 7522 - DNA, 25 bp, Homo sapiens
gtatgtgcctttggactacatcgtg

SEQ ID NO: 7523 - DNA, 25 bp, Homo sapiens
atactgcatcaggaactgattggat

SEQ ID NO: 7524 - DNA, 27 bp, Homo sapiens
agctacatctggctactgggtctctga

SEQ ID NO: 7525 - DNA, 23 bp, Homo sapiens
actgcattatgagcacttaaagt

SEQ ID NO: 7526 - DNA, 21 bp, Homo sapiens
gtgcattgtagttgcattgca

SEQ ID NO: 7527 - DNA, 24 bp, Homo sapiens
tcaagagcaataacgaaaaatgtt

SEQ ID NO: 7528 - DNA, 24 bp, Homo sapiens
tagcagcgggaacagttctgcagt

SEQ ID NO: 7529 - DNA, 23 bp, Homo sapiens
ctgggagaaggctgtttactctt

SEQ ID NO: 7530 - DNA, 24 bp, Homo sapiens
tggagacgcggccctgttggagta

SEQ ID NO: 7531 - DNA, 23 bp, Homo sapiens
tttggcactagcacatttttgct

SEQ ID NO: 7532 - DNA, 26 bp, Homo sapiens
aatccttggaacctaggtgtgagtgc

SEQ ID NO: 7533 - DNA, 23 bp, Homo sapiens
tgctggatcagtggttcgagtct

SEQ ID NO: 7534 - DNA, 22 bp, Homo sapiens
ctccgtttgcctgtttcgctga

SEQ ID NO: 7535 - DNA, 22 bp, Homo sapiens
actccagccccacagcctcagc

SEQ ID NO: 7536 - DNA, 22 bp, Homo sapiens
ttataaagcaatgagactgatt

SEQ ID NO: 7537 - DNA, 22 bp, Homo sapiens
cagcagcacactgtggtttgta

SEQ ID NO: 7538 - DNA, 21 bp, Homo sapiens
gcccctgggcctatcctagaa

SEQ ID NO: 7539 - DNA, 24 bp, Homo sapiens
ctgccctggcccgagggaccgact

SEQ ID NO: 7540 - DNA, 26 bp, Homo sapiens
rgcttctttacagtgctgccttgtag

SEQ ID NO: 7541 - DNA, 22 bp, Homo sapiens
tgttgtacttttttttttgttc

SEQ ID NO: 7542 - DNA, 23 bp, Homo sapiens
tctctgggcctgtgtcttaggct

SEQ ID NO: 7543 - DNA, 24 bp, Homo sapiens
attacagttgttcaaccagttact

SEQ ID NO: 7544 - DNA, 26 bp, Homo sapiens
cataaagctagataaccgaaagtara

SEQ ID NO: 7545 - DNA, 24 bp, Homo sapiens
aacattcattgttgtcggtgggtt

SEQ ID NO: 7546 - DNA, 24 bp, Homo sapiens
gagaattgtggctggacatctgtg

SEQ ID NO: 7547 - DNA, 25 bp, Homo sapiens
gctggtttcacatggtggcttagat

SEQ ID NO: 7548 - DNA, 24 bp, Homo sapiens
cgtgtcttttgctctgcagtcagt

SEQ ID NO: 7549 - DNA, 23 bp, Homo sapiens
atattgcacattactaagttgca

SEQ ID NO: 7550 - DNA, 24 bp, Homo sapiens
caaagtgctcatagtgcaggtagt

SEQ ID NO: 7551 - DNA, 23 bp, Homo sapiens
ttttgcaatatgttcctgaatat

SEQ ID NO: 7552 - DNA, 23 bp, Homo sapiens
tctacagtgcacgtgtctccagt

SEQ ID NO: 7553 - DNA, 25 bp, Homo sapiens
ttgtgcttgatctaaccatgtggtt

SEQ ID NO: 7554 - DNA, 23 bp, Homo sapiens
actctagctgccaaaggcgcttc

SEQ ID NO: 7555 - DNA, 22 bp, Homo sapiens
aactggcctacaaagtcccagt

SEQ ID NO: 7556 - DNA, 23 bp, Homo sapiens
aaggagcttacaatctagctggg

SEQ ID NO: 7557 - DNA, 25 bp, Homo sapiens
aactgtttgcagaggaaactgagac

SEQ ID NO: 7558 - DNA, 25 bp, Homo sapiens
ttgcagctgcctgggagtgacttca

SEQ ID NO: 7559 - DNA, 23 bp, Homo sapiens
cctcagggctgtagaacagggct

SEQ ID NO: 7560 - DNA, 23 bp, Homo sapiens
tacgtcatcgttgtcatcgtcat

SEQ ID NO: 7561 - DNA, 26 bp, Homo sapiens
ggctcagtagccagtgtagatcctgt

SEQ ID NO: 7562 - DNA, 24 bp, Homo sapiens
cgtcaacacttgctggtttcctct

SEQ ID NO: 7563 - DNA, 23 bp, Homo sapiens
accaatattactgtgctgcttta

SEQ ID NO: 7564 - DNA, 24 bp, Homo sapiens
aggcaagatgctggcatagctgtt

SEQ ID NO: 7565 - DNA, 22 bp, Homo sapiens
actctttccctgttgcactact

SEQ ID NO: 7566 - DNA, 25 bp, Homo sapiens
ctaggcagtgtagttagctgattgc

SEQ ID NO: 7567 - DNA, 23 bp, Homo sapiens
atatacaagggcaagctctctgt

SEQ ID NO: 7568 - DNA, 24 bp, Homo sapiens
ttgcatagtcacaaaagtgatcat

SEQ ID NO: 7569 - DNA, 22 bp, Homo sapiens
cgaatcattatttgctgctcta

SEQ ID NO: 7570 - DNA, 23 bp, Homo sapiens
gctgactcctagtccagggctcg

SEQ ID NO: 7571 - DNA, 21 bp, Homo sapiens
caaattcgtatctaggggaat

SEQ ID NO: 7572 - DNA, 26 bp, Homo sapiens
cacaactagactgtgagcttctagag

SEQ ID NO: 7573 - DNA, 23 bp, Homo sapiens
tgcggggctagggctaacagcag

SEQ ID NO: 7574 - DNA, 23 bp, Homo sapiens
ctgagacctctgggttctgagct

SEQ ID NO: 7575 - DNA, 23 bp, Homo sapiens
aggttgggatcggttgcaatgct

SEQ ID NO: 7576 - DNA, 22 bp, Homo sapiens
gcgacccatacttggtttcaga

SEQ ID NO: 7577 - DNA, 25 bp, Homo sapiens
ctgctatgccaacatattgccatct

SEQ ID NO: 7578 - DNA, 24 bp, Homo sapiens
tcaaatgctcagactcctgtggtg

SEQ ID NO: 7579 - DNA, 24 bp, Homo sapiens
actgtacagcctcctagctttcct

SEQ ID NO: 7580 - DNA, 22 bp, Homo sapiens
cctgttctccattacttggctc

SEQ ID NO: 7581 - DNA, 28 bp, Homo sapiens
atgcaccatggttgtctgagcatgcagc

SEQ ID NO: 7582 - DNA, 26 bp, Homo sapiens
atgattggtacgtctgtgggtagagt

SEQ ID NO: 7583 - DNA, 24 bp, Homo sapiens
actgctgagctagcacttcccgag

SEQ ID NO: 7584 - DNA, 24 bp, Homo sapiens
ttggacggagaactgataagggta

SEQ ID NO: 7585 - DNA, 24 bp, Homo sapiens
ttgattgacacttctgtgagtaga

SEQ ID NO: 7586 - DNA, 23 bp, Homo sapiens
ccaacaatatcctggtgctgagt

SEQ ID NO: 7587 - DNA, 23 bp, Homo sapiens
actgatttcttttggtgttcaga

SEQ ID NO: 7588 - DNA, 24 bp, Homo sapiens
cccataaagtagaaagcactacta

SEQ ID NO: 7589 - DNA, 23 bp, Homo sapiens
tccgtctcagttactttatagcc

SEQ ID NO: 7590 - DNA, 22 bp, Homo sapiens
agttcttcagtggcaagcttta

SEQ ID NO: 7591 - DNA, 23 bp, Homo sapiens
attctaatttctccacgtctttg

SEQ ID NO: 7592 - DNA, 27 bp, Homo sapiens
gaggtgcagtgctgcatctctggtcag

SEQ ID NO: 7593 - DNA, 22 bp, Homo sapiens
ctatacggcctcctagctttcc

SEQ ID NO: 7594 - DNA, 27 bp, Homo sapiens
aagacgggaggaaagaagggagtggtt

SEQ ID NO: 7595 - DNA, 23 bp, Homo sapiens
caacaaatcacagtctgccatat

SEQ ID NO: 7596 - DNA, 24 bp, Homo sapiens
ctcactcctctcctcccgtcttct

SEQ ID NO: 7597 - DNA, 25 bp, Homo sapiens
cagtgcaatagtattgtcaaagcat

SEQ ID NO: 7598 - DNA, 26 bp, Homo sapiens
atccccagatacaatggacaatatgc

SEQ ID NO: 7599 - DNA, 24 bp, Homo sapiens
gtgaggactcgggaggtggagggt

SEQ ID NO: 7600 - DNA, 22 bp, Homo sapiens
caggggctggctttcctctggt

SEQ ID NO: 7601 - DNA, 23 bp, Homo sapiens
ctatacaatctactgtctttcct

SEQ ID NO: 7602 - DNA, 24 bp, Homo sapiens
caccttgcgctactcaggtctgct

SEQ ID NO: 7603 - DNA, 23 bp, Homo sapiens
taatgcccctaaaaatccttatt

SEQ ID NO: 7604 - DNA, 24 bp, Homo sapiens
ttgtgcaaatctatgcaaaactga

SEQ ID NO: 7605 - DNA, 25 bp, Homo sapiens
tggaagactagtgattttgttgttg

SEQ ID NO: 7606 - DNA, 25 bp, Homo sapiens
aactggccctcaaagtcccgctttt

SEQ ID NO: 7607 - DNA, 22 bp, Homo sapiens
ccactgccccaggtgctgctgg

SEQ ID NO: 7608 - DNA, 21 bp, Homo sapiens
ctatacaacctactgccttcc

SEQ ID NO: 7609 - DNA, 24 bp, Homo sapiens
tgttcctctgtctcccagactctg

SEQ ID NO: 7610 - DNA, 24 bp, Homo sapiens
gggagccaggaagtattgatgttt

SEQ ID NO: 7611 - DNA, 24 bp, Homo sapiens
ttattgcttaagaatacgcgtagt

SEQ ID NO: 7612 - DNA, 23 bp, Homo sapiens
ctctagccacagatgcagtgatt

SEQ ID NO: 7613 - DNA, 22 bp, Homo sapiens
gttctcccaacgtaagcccagc

SEQ ID NO: 7614 - DNA, 24 bp, Homo sapiens
aacattcaacctgtcggtgagttt

SEQ ID NO: 7615 - DNA, 26 bp, Homo sapiens
caccaacctggaggactccatgctgt

SEQ ID NO: 7616 - DNA, 22 bp, Homo sapiens
ttcaacgggtatttattgagca

SEQ ID NO: 7617 - DNA, 23 bp, Homo sapiens
tcagttatcacagtgctgatgct

SEQ ID NO: 7618 - DNA, 22 bp, Homo sapiens
ttttgcgatgtgttcctaatat

SEQ ID NO: 7619 - DNA, 25 bp, Homo sapiens
tagcagcacagaaatattggcacag

SEQ ID NO: 7620 - DNA, 26 bp, Homo sapiens
tattcatttatccccagcctacaaaa

SEQ ID NO: 7621 - DNA, 22 bp, Homo sapiens
ctgttgccactaacctcaacct

SEQ ID NO: 7622 - DNA, 22 bp, Homo sapiens
caaaacgtgaggcgctgctata

SEQ ID NO: 7623 - DNA, 23 bp, Homo sapiens
ttagggccctggctccatctcct

SEQ ID NO: 7624 - DNA, 25 bp, Homo sapiens
ttgtgaaatgtttaggaccactaga

SEQ ID NO: 7625 - DNA, 24 bp, Homo sapiens
cgcatcccctagggcattggtgta

SEQ ID NO: 7626 - DNA, 25 bp, Homo sapiens
agctggtgttgtgaatcaggccgwt

SEQ ID NO: 7627 - DNA, 23 bp, Homo sapiens
caagctcgtgtctgtgggtccgt

SEQ ID NO: 7628 - DNA, 21 bp, Homo sapiens
cctctgggcccttcctccagc

SEQ ID NO: 7629 - DNA, 25 bp, Homo sapiens
ttttgttcgttcggctcgcgtgagg

SEQ ID NO: 7630 - DNA, 24 bp, Homo sapiens
catcatcgtctcaaatgagtcttc

SEQ ID NO: 7631 - DNA, 22 bp, Homo sapiens
cggggttttgagggcgagatga

SEQ ID NO: 7632 - DNA, 24 bp, Homo sapiens
gtgcctactgagctgaaacacagt

SEQ ID NO: 7633 - DNA, 24 bp, Homo sapiens
gtttttcattattgctcctgacct

SEQ ID NO: 7634 - DNA, 22 bp, Homo sapiens
gagcttattcataaaagtgcag

SEQ ID NO: 7635 - DNA, 25 bp, Homo sapiens
ctaatactgccgggtaatgatggag

SEQ ID NO: 7636 - DNA, 23 bp, Homo sapiens
cctcctgccctccttgctgtaga

SEQ ID NO: 7637 - DNA, 22 bp, Homo sapiens
aatggcgccactagggttgtgc

SEQ ID NO: 7638 - DNA, 24 bp, Homo sapiens
aatcactaaccacacggccaggta

SEQ ID NO: 7639 - DNA, 24 bp, Homo sapiens
ggtgcctactgagctgatatcagt

SEQ ID NO: 7640 - DNA, 24 bp, Homo sapiens
gaagttgttcgtggtggattcgct

SEQ ID NO: 7641 - DNA, 26 bp, Homo sapiens
aggactccatttgttttgatgatgga

SEQ ID NO: 7642 - DNA, 26 bp, Homo sapiens
aggggtgctatctgtgattgagggac

SEQ ID NO: 7643 - DNA, 27 bp, Homo sapiens
attatggtttgcctgggactgaggaat

SEQ ID NO: 7644 - DNA, 26 bp, Homo sapiens
atggttgaccagagagcacacgcttt

SEQ ID NO: 7645 - DNA, 22 bp, Homo sapiens
cagtgcaatgatgaaagggcat

SEQ ID NO: 7646 - DNA, 25 bp, Homo sapiens
tcaaacgccattatcacactaaata

SEQ ID NO: 7647 - DNA, 25 bp, Homo sapiens
catatgtctgctgaccatcaccttt

SEQ ID NO: 7648 - DNA, 23 bp, Homo sapiens
actgtacaggccactgccttgcc

SEQ ID NO: 7649 - DNA, 23 bp, Homo sapiens
ttgtacatggtaggctttcattc

SEQ ID NO: 7650 - DNA, 24 bp, Homo sapiens
aatgcacccgggcaaggattctga

SEQ ID NO: 7651 - DNA, 22 bp, Homo sapiens
ctggccctctctgcccttccgt

SEQ ID NO: 7652 - DNA, 22 bp, Homo sapiens
ttacccagtctccggtgcagcc

SEQ ID NO: 7653 - DNA, 23 bp, Homo sapiens
aaccatcgaccgttgagtggacc

SEQ ID NO: 7654 - DNA, 23 bp, Homo sapiens
ctgcgcaagctactgccttgcta

SEQ ID NO: 7655 - DNA, 24 bp, Homo sapiens
cgaataatacatggttgatctttt

SEQ ID NO: 7656 - DNA, 26 bp, Homo sapiens
tgattaatatcggacaaccattgttt

SEQ ID NO: 7657 - DNA, 23 bp, Homo sapiens
aatataacacagatggcctgttt

SEQ ID NO: 7658 - DNA, 23 bp, Homo sapiens
caacaggtgactggttagacaaa

SEQ ID NO: 7659 - DNA, 25 bp, Homo sapiens
aggttacccgagcaactttgcatct

SEQ ID NO: 7660 - DNA, 24 bp, Homo sapiens
gctcctatatgatgcctttcttca

SEQ ID NO: 7661 - DNA, 22 bp, Homo sapiens
ctcgtgggctctggccacggcc

SEQ ID NO: 7662 - DNA, 23 bp, Homo sapiens
cctcccacacccaaggcttgcaa

SEQ ID NO: 7663 - DNA, 23 bp, Homo sapiens
tgttcctgctgaactgagccagt

SEQ ID NO: 7664 - DNA, 27 bp, Homo sapiens
cgtgtatttgacaagctgagttggaca

SEQ ID NO: 7665 - DNA, 22 bp, Homo sapiens
ccagtattaactgtgctgctga

SEQ ID NO: 7666 - DNA, 23 bp, Homo sapiens
gagggccccccctcaatcctgtt

SEQ ID NO: 7667 - DNA, 26 bp, Homo sapiens
agtaagtgcttccatgtttyrgtrrd

SEQ ID NO: 7668 - DNA, 24 bp, Homo sapiens
tactccagagggcgtcactcatgt

SEQ ID NO: 7669 - DNA, 24 bp, Homo sapiens
aaagtgctgcgacatttgagcgtc

SEQ ID NO: 7670 - DNA, 23 bp, Homo sapiens
ttataatacaacctgataagtgt

SEQ ID NO: 7671 - DNA, 23 bp, Homo sapiens
ctgggaggtggatgtttacttca

SEQ ID NO: 7672 - DNA, 21 bp, Homo sapiens
ctacagtatagatgatgtact

SEQ ID NO: 7673 - DNA, 25 bp, Homo sapiens
tagtgcaatattgcttatagggttt

SEQ ID NO: 7674 - DNA, 22 bp, Homo sapiens
tttaggataagcttgacttttg

SEQ ID NO: 7675 - DNA, 25 bp, Homo sapiens
tttgtaaggcacccttctgagtaga

SEQ ID NO: 7676 - DNA, 25 bp, Homo sapiens
atcatacaaggacaatttctttttg

SEQ ID NO: 7677 - DNA, 23 bp, Homo sapiens
tctctcggctcctcgcggctcgc

SEQ ID NO: 7678 - DNA, 24 bp, Homo sapiens
gaagtgcttcgattttggggtgtc

SEQ ID NO: 7679 - DNA, 23 bp, Homo sapiens
tacagcaggcacagacaggcagt

SEQ ID NO: 7680 - DNA, 27 bp, Homo sapiens
tgctgaagctcagagggctctgattca

SEQ ID NO: 7681 - DNA, 24 bp, Homo sapiens
gctggtttcatatggtggtttaga

SEQ ID NO: 7682 - DNA, 22 bp, Homo sapiens
actctagagggaagcgctttct

SEQ ID NO: 7683 - DNA, 22 bp, Homo sapiens
gctctgactttattgcactact

SEQ ID NO: 7684 - DNA, 23 bp, Homo sapiens
gcmcawtacacggtcgacctctt

SEQ ID NO: 7685 - DNA, 23 bp, Homo sapiens
caagctcgcttctatgggtctgt

SEQ ID NO: 7686 - DNA, 25 bp, Homo sapiens
tcttctctgttttggccatgtgtgt

SEQ ID NO: 7687 - DNA, 23 bp, Homo sapiens
aacatagaggaaattccacgttt

SEQ ID NO: 7688 - DNA, 24 bp, Homo sapiens
ggagaaattatccttggtgtgttc

SEQ ID NO: 7689 - DNA, 23 bp, Homo sapiens
catcgggaatgtcgtgtccgccc

SEQ ID NO: 7690 - DNA, 24 bp, Homo sapiens
tactgtagtatgggcacttccagt

SEQ ID NO: 7691 - DNA, 25 bp, Homo sapiens
aggaagccctggaggggctggaggt

SEQ ID NO: 7692 - DNA, 24 bp, Homo sapiens
gtaacagtctccagtcacggccac

SEQ ID NO: 7693 - DNA, 25 bp, Homo sapiens
ttgcaggtcgtcttgcagggcttct

SEQ ID NO: 7694 - DNA, 22 bp, Homo sapiens
cctggtacaggcctgggggaca

SEQ ID NO: 7695 - DNA, 23 bp, Homo sapiens
atagtagaccgtatagcgtacgc

SEQ ID NO: 7696 - DNA, 26 bp, Homo sapiens
gagtcatacacggctctcctctcttt

SEQ ID NO: 7697 - DNA, 23 bp, Homo sapiens
gtgaaggtctactgtgtgccagg

SEQ ID NO: 7698 - DNA, 27 bp, Homo sapiens
ttgagaactgaattccatgggttgtgt

SEQ ID NO: 7699 - DNA, 24 bp, Homo sapiens
tgatatgtttgatatattaggttg

SEQ ID NO: 7700 - DNA, 25 bp, Homo sapiens
ggaagcccttaccccaaaaagyatt

SEQ ID NO: 7701 - DNA, 23 bp, Homo sapiens
ctcagtctcatctgcaaagaagt

SEQ ID NO: 7702 - DNA, 24 bp, Homo sapiens
ggatatcatcatatactgtaagtt

SEQ ID NO: 7703 - DNA, 23 bp, Homo sapiens
ccagttaccgcttccgctaccgc

SEQ ID NO: 7704 - DNA, 22 bp, Homo sapiens
taggttatccgtgttgccttcg

SEQ ID NO: 7705 - DNA, 22 bp, Homo sapiens
gtccctctccaaatgtgtcttg

SEQ ID NO: 7706 - DNA, 24 bp, Homo sapiens
tccctgtcctccaggagctcacgt

SEQ ID NO: 7707 - DNA, 24 bp, Homo sapiens
tgaggtagtaagttgtattgttgt

SEQ ID NO: 7708 - DNA, 28 bp, Homo sapiens
acttaaacgtggatgtacttgctttgaa

SEQ ID NO: 7709 - DNA, 22 bp, Homo sapiens
tccgagcctgggtctccctctt

SEQ ID NO: 7710 - DNA, 27 bp, Homo sapiens
wggcagtgtattgttagctggytgctt

SEQ ID NO: 7711 - DNA, 22 bp, Homo sapiens
ccacctcccctgcaaacgtcca

SEQ ID NO: 7712 - DNA, 24 bp, Homo sapiens
acagcagcaattcatgttttgaag

SEQ ID NO: 7713 - DNA, 23 bp, Homo sapiens
taagtgcttccatgtttgagtgt

SEQ ID NO: 7714 - DNA, 23 bp, Homo sapiens
aaacaaacatggtgcacttcttt

SEQ ID NO: 7715 - DNA, 24 bp, Homo sapiens
tgccctgtggactcagttctggtg

SEQ ID NO: 7716 - DNA, 25 bp, Homo sapiens
tcttggagtaggtcattgggtggat

SEQ ID NO: 7717 - DNA, 24 bp, Homo sapiens
tgattgtccaaacgcaattctygt

SEQ ID NO: 7718 - DNA, 26 bp, Homo sapiens
cgaatgttgctcggtgaacccctttt

SEQ ID NO: 7719 - DNA, 23 bp, Homo sapiens
agagtctccagtaatggacggga

SEQ ID NO: 7720 - DNA, 23 bp, Homo sapiens
taacagtctacagccatggtcgc

SEQ ID NO: 7721 - DNA, 25 bp, Homo sapiens
aggcctattcttgattacttgtttc

SEQ ID NO: 7722 - DNA, 25 bp, Homo sapiens
cctcaaatgtggagcactattctga

SEQ ID NO: 7723 - DNA, 24 bp, Homo sapiens
tgcctgctggggtggaacctggtc

SEQ ID NO: 7724 - DNA, 24 bp, Homo sapiens
tactcaaaatgggggcgctttcct

SEQ ID NO: 7725 - DNA, 24 bp, Homo sapiens
tttgtgacctggtccactaaccct

SEQ ID NO: 7726 - DNA, 27 bp, Homo sapiens
gtgtgtgactggttgaccagaggggca

SEQ ID NO: 7727 - DNA, 24 bp, Homo sapiens
actcaaactgtgggggcactttct

SEQ ID NO: 7728 - DNA, 24 bp, Homo sapiens
gcagtgcaatgttaaaagggcatt

SEQ ID NO: 7729 - DNA, 25 bp, Homo sapiens
tacccattgcatatcggagttgtga

SEQ ID NO: 7730 - DNA, 24 bp, Homo sapiens
atattgcactcgtcccggcctccg

SEQ ID NO: 7731 - DNA, 23 bp, Homo sapiens
tgtctactactggagacactggt

SEQ ID NO: 7732 - DNA, 25 bp, Homo sapiens
atgcagtccatgggcatatacactt

SEQ ID NO: 7733 - DNA, 24 bp, Homo sapiens
ttgtgacagattgataactgaaag

SEQ ID NO: 7734 - DNA, 23 bp, Homo sapiens
atgtagggatggaagccatgaaa

SEQ ID NO: 7735 - DNA, 25 bp, Homo sapiens
tcaacaaaatcactgatgctggagt

SEQ ID NO: 7736 - DNA, 25 bp, Homo sapiens
cggggccgtagcactgtctgagagg

SEQ ID NO: 7737 - DNA, 23 bp, Homo sapiens
tgagtaccgccatgtctgttggg

SEQ ID NO: 7738 - DNA, 25 bp, Homo sapiens
agatcgaccgtgttatattcgcttt

SEQ ID NO: 7739 - DNA, 25 bp, Homo sapiens
ctcctgactccaggtcctgtgtgtt

SEQ ID NO: 7740 - DNA, 23 bp, Homo sapiens
atataatacaacctgctaagtgt

SEQ ID NO: 7741 - DNA, 22 bp, Homo sapiens
atggttgaccatagaacatgcg

SEQ ID NO: 7742 - DNA, 25 bp, Homo sapiens
ttaaggcacgcggtgaatgccaaga

SEQ ID NO: 7743 - DNA, 27 bp, Homo sapiens
ttgtaactggttgaacaactgaaccca

SEQ ID NO: 7744 - DNA, 23 bp, Homo sapiens
cagtggttttaccctatggtagg

SEQ ID NO: 7745 - DNA, 26 bp, Homo sapiens
catcggatccgtctgagcttggctgg

SEQ ID NO: 7746 - DNA, 25 bp, Homo sapiens
actggagatatggaagagctgtgtt

SEQ ID NO: 7747 - DNA, 20 bp, Homo sapiens
atgcacagatctcagacatc

SEQ ID NO: 7748 - DNA, 22 bp, Homo sapiens
tgcaacttacctgagtcattga

SEQ ID NO: 7749 - DNA, 25 bp, Homo sapiens
ttaatctcagctggcaactgtgaga

SEQ ID NO: 7750 - DNA, 23 bp, Homo sapiens
cattattacttttggtacgcgct

SEQ ID NO: 7751 - DNA, 23 bp, Homo sapiens
tcgaggagctcacagtctagtat

SEQ ID NO: 7752 - DNA, 25 bp, Homo sapiens
ttttcctatgcatatacttctttga

SEQ ID NO: 7753 - DNA, 22 bp, Homo sapiens
ctcctacatattagcattaaca

SEQ ID NO: 7754 - DNA, 26 bp, Homo sapiens
gtgaacgggcgccatcccgaggcttt

SEQ ID NO: 7755 - DNA, 24 bp, Homo sapiens
gacctctgaaattcagttcttcag

SEQ ID NO: 7756 - DNA, 23 bp, Homo sapiens
tactgcagacgtggcaatcatgt

SEQ ID NO: 7757 - DNA, 23 bp, Homo sapiens
ctttcagtcagatgtttgctgct

SEQ ID NO: 7758 - DNA, 23 bp, Homo sapiens
ataatacatggttaacctctttt

SEQ ID NO: 7759 - DNA, 23 bp, Homo sapiens
aatcatacacggttgacctattt

SEQ ID NO: 7760 - DNA, 24 bp, Homo sapiens
ttctcaaggaggtgtcgtttatgt

SEQ ID NO: 7761 - DNA, 31 bp, Homo sapiens
aagccaggtcacgtctctgcagttacacagc

SEQ ID NO: 7762 - DNA, 24 bp, Homo sapiens
ctcttgagggaagcactttctgtt

SEQ ID NO: 7763 - DNA, 23 bp, Homo sapiens
agaggttgcccttggtgaattcg

SEQ ID NO: 7764 - DNA, 24 bp, Homo sapiens
aatcatagaggaaaatccaygttt

SEQ ID NO: 7765 - DNA, 27 bp, Homo sapiens
ttaatgctaatcgtgataggggttttt

SEQ ID NO: 7766 - DNA, 24 bp, Homo sapiens
atggtttaccgtcccacatacatt

SEQ ID NO: 7767 - DNA, 25 bp, Homo sapiens
atggtcgaccagttggaaagtaatt

SEQ ID NO: 7768 - DNA, 24 bp, Homo sapiens
aagtgccgccatcttttgagtgtt

SEQ ID NO: 7769 - DNA, 23 bp, Homo sapiens
atgtagggctaaaagccatgggc

SEQ ID NO: 7770 - DNA, 22 bp, Homo sapiens
cactgtgtcctttctgcgtaga

SEQ ID NO: 7771 - DNA, 26 bp, Homo sapiens
taaagaggtatagggcatgggaaaac

SEQ ID NO: 7772 - DNA, 26 bp, Homo sapiens
aatcctttgtccctgggtgagagtgc

SEQ ID NO: 7773 - DNA, 23 bp, Homo sapiens
aaacattcgcggtgcacttcttt

SEQ ID NO: 7774 - DNA, 23 bp, Homo sapiens
tgaaacatacacgggaaacctct

SEQ ID NO: 7775 - DNA, 22 bp, Homo sapiens
tatgtaacacggtccactaacc

SEQ ID NO: 7776 - DNA, 27 bp, Homo sapiens
atggtgggccgcagaacatgtgctgag

SEQ ID NO: 7777 - DNA, 25 bp, Homo sapiens
aatcgtacagggtcatccacttttt

SEQ ID NO: 7778 - DNA, 22 bp, Homo sapiens
gtggttatccctgctgtgttcg

SEQ ID NO: 7779 - DNA, 24 bp, Homo sapiens
catcagggcttgtggaatgggaag

SEQ ID NO: 7780 - DNA, 24 bp, Homo sapiens
gatcatgatgggctcctcggtgtt

SEQ ID NO: 7781 - DNA, 23 bp, Homo sapiens
aatcattcacggacaacactttt

SEQ ID NO: 7782 - DNA, 24 bp, Homo sapiens
catctcactgtagcctcgaacccc

SEQ ID NO: 7783 - DNA, 28 bp, Homo sapiens
ctgggtttacgttgggagaacttttacg

SEQ ID NO: 7784 - DNA, 23 bp, Homo sapiens
aaccgtggctttcgattgttact

SEQ ID NO: 7785 - DNA, 22 bp, Homo sapiens
catcccttgcatggtggagggt

SEQ ID NO: 7786 - DNA, 23 bp, Homo sapiens
tgtcttgcaggccgtcatgcagg

SEQ ID NO: 7787 - DNA, 21 bp, Homo sapiens
gtgcattgctgttgcattgca

SEQ ID NO: 7788 - DNA, 24 bp, Homo sapiens
gaaagtgcttccctttggactgtt

SEQ ID NO: 7789 - DNA, 25 bp, Homo sapiens
cagatcagaaggtgattgtggcttt

SEQ ID NO: 7790 - DNA, 23 bp, Homo sapiens
gtagattctccttctatgagtac

SEQ ID NO: 7791 - DNA, 23 bp, Homo sapiens
aatcacacaaaggcaacttttgt

SEQ ID NO: 7792 - DNA, 25 bp, Homo sapiens
tctcacacagaaatcgcacccgtca

SEQ ID NO: 7793 - DNA, 23 bp, Homo sapiens
tactcaaaaagctgtcagtcact

SEQ ID NO: 7794 - DNA, 24 bp, Homo sapiens
cagttgctagttgcactcctctct

SEQ ID NO: 7795 - DNA, 23 bp, Homo sapiens
ctccggttctcagggctccacct

SEQ ID NO: 7796 - DNA, 24 bp, Homo sapiens
tgaggggcagagagcgagactttt

SEQ ID NO: 7797 - DNA, 23 bp, Homo sapiens
ctgtcgattggacccgccctccg

SEQ ID NO: 7798 - DNA, 24 bp, Homo sapiens
aaagtgctgtcatagctgaggtcc

SEQ ID NO: 7799 - DNA, 23 bp, Homo sapiens
aaggcagggcccccgctccccgg

SEQ ID NO: 7800 - DNA, 23 bp, Homo sapiens
tctgtcatttctttaggccaata

SEQ ID NO: 7801 - DNA, 23 bp, Homo sapiens
ctctagagggaagcactttctct

SEQ ID NO: 7802 - DNA, 23 bp, Homo sapiens
ctccagagggaagtactttctgt

SEQ ID NO: 7803 - DNA, 23 bp, Homo sapiens
gtaattttatgtataagctagtc

SEQ ID NO: 7804 - DNA, 23 bp, Homo sapiens
ccaatattggctgtgctgctcca

SEQ ID NO: 7805 - DNA, 23 bp, Homo sapiens
tgagtattacatggccaatctcc

SEQ ID NO: 7806 - DNA, 23 bp, Homo sapiens
tgatatgtttgatattgggttgt

SEQ ID NO: 7807 - DNA, 22 bp, Homo sapiens
aattgcactttagcaatggtga

SEQ ID NO: 7808 - DNA, 23 bp, Homo sapiens
tgagcgcctcgacgacagagccg

SEQ ID NO: 7809 - DNA, 22 bp, Homo sapiens
aacacacctggttaacctcttt

SEQ ID NO: 7810 - DNA, 22 bp, Homo sapiens
ggggttcctggggatgggattt

SEQ ID NO: 7811 - DNA, 23 bp, Homo sapiens
tactctggagagtgacaatcatg

SEQ ID NO: 7812 - DNA, 25 bp, Homo sapiens
aaaaactgtaattacttttggacca

SEQ ID NO: 7813 - DNA, 26 bp, Homo sapiens
cccatccgcgctctgactctctgccc

SEQ ID NO: 7814 - DNA, 25 bp, Homo sapiens
tgtagtgtttcctactttatggatg

SEQ ID NO: 7815 - DNA, 23 bp, Homo sapiens
gcaaagcacacggcctgcagaga

SEQ ID NO: 7816 - DNA, 22 bp, Homo sapiens
tcaccagccctgtgttccctag

SEQ ID NO: 7817 - DNA, 25 bp, Homo sapiens
ttggcagtgtcttagctggttgttg

SEQ ID NO: 7818 - DNA, 22 bp, Homo sapiens
gctgcgcttggatttcgtcccc

SEQ ID NO: 7819 - DNA, 22 bp, Homo sapiens
acaggtgaggttcttgggagcc

SEQ ID NO: 7820 - DNA, 24 bp, Homo sapiens
gagcctctaagaagttgactgaag

SEQ ID NO: 7821 - DNA, 25 bp, Homo sapiens
cagctacattgtctgctgggtttca

SEQ ID NO: 7822 - DNA, 26 bp, Homo sapiens
aaaccgttaccattactgagtttagt

SEQ ID NO: 7823 - DNA, 22 bp, Homo sapiens
ctgtgggccacctagtcaccaa

SEQ ID NO: 7824 - DNA, 24 bp, Homo sapiens
ttctcgaggaaagaagcactttct

SEQ ID NO: 7825 - DNA, 22 bp, Homo sapiens
cttggcacctagcaagcactca

SEQ ID NO: 7826 - DNA, 22 bp, Homo sapiens
tggtgggcacagaatctggact

SEQ ID NO: 7827 - DNA, 21 bp, Homo sapiens
gcgacccactcttggtttcca

SEQ ID NO: 7828 - DNA, 24 bp, Homo sapiens
ctcggggatcatcatgtcacgaga

SEQ ID NO: 7829 - DNA, 24 bp, Homo sapiens
gatcgtgcatccctttagagtgtt

SEQ ID NO: 7830 - DNA, 22 bp, Homo sapiens
tgtcttactccctcaggcacat

SEQ ID NO: 7831 - DNA, 23 bp, Homo sapiens
atcaacagacattaattgggcgc

SEQ ID NO: 7832 - DNA, 23 bp, Homo sapiens
aatcatacagggacatccagttt

SEQ ID NO: 7833 - DNA, 26 bp, Homo sapiens
gtgtcagtttgtcaaataccccaagt

SEQ ID NO: 7834 - DNA, 23 bp, Homo sapiens
tctgctcataccccatggtttct

SEQ ID NO: 7835 - DNA, 24 bp, Homo sapiens
caatcactaactccactgccatca

SEQ ID NO: 7836 - DNA, 22 bp, Homo sapiens
acgcccttcccccccttcttca

SEQ ID NO: 7837 - DNA, 21 bp, Homo sapiens
ctcccacatgcagggtttgca

SEQ ID NO: 7838 - DNA, 23 bp, Homo sapiens
agagttgagtctggacgtcccga

SEQ ID NO: 7839 - DNA, 23 bp, Homo sapiens
ccacttggatctgaaggctgccc

SEQ ID NO: 7840 - DNA, 25 bp, Homo sapiens
acttatcagattgtattgtaattgt

SEQ ID NO: 7841 - DNA, 22 bp, Homo sapiens
ttttgcaccttttggagtgaaa

SEQ ID NO: 7842 - DNA, 23 bp, Homo sapiens
tgagaaccacgtctgctctgagc

SEQ ID NO: 7843 - DNA, 25 bp, Homo sapiens
taggcagtgtcattagctgattgta

SEQ ID NO: 7844 - DNA, 24 bp, Homo sapiens
ttcacagggaggtgtcatttatgt

SEQ ID NO: 7845 - DNA, 24 bp, Homo sapiens
ctgaggagatcgtcgaggttggcc

SEQ ID NO: 7846 - DNA, 25 bp, Homo sapiens
ctgtgcaaatccatgcaaaactgat

SEQ ID NO: 7847 - DNA, 22 bp, Homo sapiens
atatagggattggagccgtggc

SEQ ID NO: 7848 - DNA, 24 bp, Homo sapiens
ctgccctggcccgagggaccgact

SEQ ID NO: 7849 - DNA, 23 bp, Homo sapiens
agaggctggccgtgatgaattcg

SEQ ID NO: 7850 - DNA, 24 bp, Homo sapiens
caaggagctcacagtctattgagt

SEQ ID NO: 7851 - DNA, 23 bp, Homo sapiens
ccaatattggctgtgctgctcca

SEQ ID NO: 7852 - DNA, 24 bp, Homo sapiens
actcaaaacccttcagtgacttcc

SEQ ID NO: 7853 - DNA, 23 bp, Homo sapiens
actggctagggaaaatgattgga

SEQ ID NO: 7854 - DNA, 22 bp, Homo sapiens
agaccctggtctgcactctatc

SEQ ID NO: 7855 - DNA, 27 bp, Homo sapiens
atggtagactatggaacgtaggcgtta

SEQ ID NO: 7856 - DNA, 24 bp, Homo sapiens
aaacccgtagatccgatcttgtgg

SEQ ID NO: 7857 - DNA, 26 bp, Homo sapiens
gccatagcccggtcgctggtacatga

SEQ ID NO: 7858 - DNA, 27 bp, Homo sapiens
agtcccccaggtgtgattctgatttgc

SEQ ID NO: 7859 - DNA, 24 bp, Homo sapiens
tcgaccggacctcgaccggctcgt

SEQ ID NO: 7860 - DNA, 22 bp, Homo sapiens
aaatggtgccctagtgactaca

SEQ ID NO: 7861 - DNA, 23 bp, Homo sapiens
tgcggggctagggctaacagcag

SEQ ID NO: 7862 - DNA, 23 bp, Homo sapiens
aacacacctattcaaggattcaa

SEQ ID NO: 7863 - DNA, 24 bp, Homo sapiens
aaaatctctgcaggcaaatgtgat

SEQ ID NO: 7864 - DNA, 23 bp, Homo sapiens
gtataggcctttagatcatctga

SEQ ID NO: 7865 - DNA, 23 bp, Homo sapiens
actttaacatggaagtgctttct

SEQ ID NO: 7866 - DNA, 23 bp, Homo sapiens
cagtgcaatgatattgtcaaagc

SEQ ID NO: 7867 - DNA, 25 bp, Homo sapiens
actgtgcgtgtgacagcggctgatc

SEQ ID NO: 7868 - DNA, 24 bp, Homo sapiens
actgccctaagtgctccttctggc

SEQ ID NO: 7869 - DNA, 23 bp, Homo sapiens
tcactggctcctttctgggtaga

SEQ ID NO: 7870 - DNA, 22 bp, Homo sapiens
agggggaaagttctatagtcct

SEQ ID NO: 7871 - DNA, 24 bp, Homo sapiens
ctctggagggaagcactttctgtt

SEQ ID NO: 7872 - DNA, 23 bp, Homo sapiens
gtcagtgcatgacagaacttggg

SEQ ID NO: 7873 - DNA, 25 bp, Homo sapiens
tgtctcccaacccttgtaccagtgc

SEQ ID NO: 7874 - DNA, 22 bp, Homo sapiens
ggaggaaccttggagcttcggc

SEQ ID NO: 7875 - DNA, 25 bp, Homo sapiens
gctttaacatgggggtacctgctgt

SEQ ID NO: 7876 - DNA, 23 bp, Homo sapiens
tggagagaaaggcagttcctgat

SEQ ID NO: 7877 - DNA, 22 bp, Homo sapiens
cacgctcatgcacacacccaca

SEQ ID NO: 7878 - DNA, 24 bp, Homo sapiens
tcaggctcagtcccctcccgataa

SEQ ID NO: 7879 - DNA, 23 bp, Homo sapiens
ttctccaaaagggagcactttct

SEQ ID NO: 7880 - DNA, 23 bp, Homo sapiens
ttcacaaggaggtgtcatttatg

SEQ ID NO: 7881 - DNA, 22 bp, Homo sapiens
tacgtagatatatatgtatttt

SEQ ID NO: 7882 - DNA, 25 bp, Homo sapiens
acccagtgttcagactacctgttca

SEQ ID NO: 7883 - DNA, 24 bp, Homo sapiens
gmaagtgcttccttttagaggstt

SEQ ID NO: 7884 - DNA, 24 bp, Homo sapiens
tcagaacaaatgccggttcccaga

SEQ ID NO: 7885 - DNA, 24 bp, Homo sapiens
tcctgtactgagctgccccgaggc

SEQ ID NO: 7886 - DNA, 24 bp, Homo sapiens
tagcagcacataatggtttgtgga

SEQ ID NO: 7887 - DNA, 22 bp, Homo sapiens
agtgcctgagggagtaagagcc

SEQ ID NO: 7888 - DNA, 25 bp, Homo sapiens
ccctctagatggaagcactgtctgt

SEQ ID NO: 7889 - DNA, 22 bp, Homo sapiens
cacagtggtctctgggattatg

SEQ ID NO: 7890 - DNA, 23 bp, Homo sapiens
actttaacatggaggcacttgct

SEQ ID NO: 7891 - DNA, 23 bp, Homo sapiens
gtatgtgggatggtaaaccgctt

SEQ ID NO: 7892 - DNA, 22 bp, Homo sapiens
ttctcaagagggaggcaatcat

SEQ ID NO: 7893 - DNA, 24 bp, Homo sapiens
tactgcagacagtggcaatcatgt

SEQ ID NO: 7894 - DNA, 32 bp, Homo sapiens
caaccagatttcagtggagtgaagttcaggag

SEQ ID NO: 7895 - DNA, 22 bp, Homo sapiens
tatgtaacatggtccactaact

SEQ ID NO: 7896 - DNA, 26 bp, Homo sapiens
tacatctgggcaactgactgaacttt

SEQ ID NO: 7897 - DNA, 25 bp, Homo sapiens
ctccagcatcagtgattttgttgaa

SEQ ID NO: 7898 - DNA, 30 bp, Homo sapiens
tgtatggcactggtagaattcactgtgaac

SEQ ID NO: 7899 - DNA, 24 bp, Homo sapiens
caaagcgctcccctttagaggttt

SEQ ID NO: 7900 - DNA, 25 bp, Homo sapiens
agtggggaacccttccatgaggagt

SEQ ID NO: 7901 - DNA, 23 bp, Homo sapiens
ttaagacttgcagtgatgtttaa

SEQ ID NO: 7902 - DNA, 22 bp, Homo sapiens
cgcggggatcgccgagggccgg

SEQ ID NO: 7903 - DNA, 23 bp, Homo sapiens
cccagataatggcactctcaaac

SEQ ID NO: 7904 - DNA, 22 bp, Homo sapiens
gtggatattccttctatgttta

SEQ ID NO: 7905 - DNA, 23 bp, Homo sapiens
ctgtcctaaggttgttgagttgt

SEQ ID NO: 7906 - DNA, 22 bp, Homo sapiens
cttagcaggttgtattatcatt

SEQ ID NO: 7907 - DNA, 26 bp, Homo sapiens
tgaaaatgatgagtagtgactgatga

SEQ ID NO: 7908 - DNA, 23 bp, Homo sapiens
tagtggatgatgcactctgtgca

SEQ ID NO: 7909 - DNA, 22 bp, Homo sapiens
ctggggttctgagacagacagt

SEQ ID NO: 7910 - DNA, 22 bp, Homo sapiens
ggctgggaaggcaaagggacgt

SEQ ID NO: 7911 - DNA, 22 bp, Homo sapiens
caagaacctcagttgcttttgt

SEQ ID NO: 7912 - DNA, 24 bp, Homo sapiens
taaagtgcttatagtgcaggtagt

SEQ ID NO: 7913 - DNA, 24 bp, Homo sapiens
ttcattcggctgtccagatgtatc

SEQ ID NO: 7914 - DNA, 26 bp, Homo sapiens
gtcttaccagacatggttagacctgg

SEQ ID NO: 7915 - DNA, 23 bp, Homo sapiens
aacatagaggaaattccacgttt

SEQ ID NO: 7916 - DNA, 25 bp, Homo sapiens
atttgggactgatcttgatgtctgc

SEQ ID NO: 7917 - DNA, 25 bp, Homo sapiens
atacccagagcatgcagtgtgaaca

SEQ ID NO: 7918 - DNA, 24 bp, Homo sapiens
agaagcattctttcattggttggt

SEQ ID NO: 7919 - DNA, 20 bp, Homo sapiens
ccatggatctccaggtgggt

SEQ ID NO: 7920 - DNA, 26 bp, Homo sapiens
mtctttggttatctagctgtatgagt

SEQ ID NO: 7921 - DNA, 21 bp, Homo sapiens
ctatacaatctattgccttcc

SEQ ID NO: 7922 - DNA, 23 bp, Homo sapiens
tgtgatatcatggttcctgggag

SEQ ID NO: 7923 - DNA, 24 bp, Homo sapiens
attgtccttgctgtttggagataa

SEQ ID NO: 7924 - DNA, 23 bp, Homo sapiens
agtggttcttaacagttcaacag

SEQ ID NO: 7925 - DNA, 25 bp, Homo sapiens
aatgacacgatcactcccgttgagt

SEQ ID NO: 7926 - DNA, 23 bp, Homo sapiens
awmgtgcatccttttagagkktt

SEQ ID NO: 7927 - DNA, 24 bp, Homo sapiens
taaagtgctgacagtgcagatagt

SEQ ID NO: 7928 - DNA, 26 bp, Homo sapiens
acctggcatacaatgtagatttctgt

SEQ ID NO: 7929 - DNA, 23 bp, Homo sapiens
tatacctcagttttatcaggtgt

SEQ ID NO: 7930 - DNA, 22 bp, Homo sapiens
ttttcaactctaatgggagaga

SEQ ID NO: 7931 - DNA, 26 bp, Homo sapiens
tgaaaatgatgagtagtgactgatga

SEQ ID NO: 7932 - DNA, 23 bp, Homo sapiens
actcactgatcaatgaatgcaaa

SEQ ID NO: 7933 - DNA, 22 bp, Homo sapiens
ttctagtaagagtggcagtcga

SEQ ID NO: 7934 - DNA, 23 bp, Homo sapiens
ctacaaagggaagccctttctgt

SEQ ID NO: 7935 - DNA, 25 bp, Homo sapiens
tacagtagtctgcacattggttaga

SEQ ID NO: 7936 - DNA, 23 bp, Homo sapiens
gaacatcacagcaagtctgtgct

SEQ ID NO: 7937 - DNA, 22 bp, Homo sapiens
aaaatggttccctttagagtgt

SEQ ID NO: 7938 - DNA, 22 bp, Homo sapiens
aggtcctcaataagtatttgtt

SEQ ID NO: 7939 - DNA, 24 bp, Homo sapiens
aagctcggtctgaggcccctcagt

SEQ ID NO: 7940 - DNA, 23 bp, Homo sapiens
acaagtcttatttgagcacctgt

SEQ ID NO: 7941 - DNA, 23 bp, Homo sapiens
caccaggcattgtggtctccgct

SEQ ID NO: 7942 - DNA, 22 bp, Homo sapiens
ttgcatatgtaggatgtcccat

SEQ ID NO: 7943 - DNA, 23 bp, Homo sapiens
cggctacttcacaacaccagggc

SEQ ID NO: 7944 - DNA, 21 bp, Homo sapiens
gtgtgcggaaatgcttctgct

SEQ ID NO: 7945 - DNA, 23 bp, Homo sapiens
ctccagagggatgcactttctct

SEQ ID NO: 7946 - DNA, 24 bp, Homo sapiens
tccctgagaccctttaacctgtga

SEQ ID NO: 7947 - DNA, 22 bp, Homo sapiens
tcaaaactgaggggcattttct

SEQ ID NO: 7948 - DNA, 24 bp, Homo sapiens
ggactatagaactttccccctcat

SEQ ID NO: 7949 - DNA, 23 bp, Homo sapiens
gaacatcctgcatagtgctgcca

SEQ ID NO: 7950 - DNA, 26 bp, Homo sapiens
ccatctggaggtaagaagcactttst

SEQ ID NO: 7951 - DNA, 23 bp, Homo sapiens
cgtgttcacagcggaccttgatt

SEQ ID NO: 7952 - DNA, 23 bp, Homo sapiens
actcagccttgagggcactttct

SEQ ID NO: 7953 - DNA, 25 bp, Homo sapiens
agctggtgttgtgaatcaggccgwt

SEQ ID NO: 7954 - DNA, 24 bp, Homo sapiens
gaaagtgcttctctttggtgggtt

SEQ ID NO: 7955 - DNA, 23 bp, Homo sapiens
ggggtattgtttccgctgccagg

SEQ ID NO: 7956 - DNA, 26 bp, Homo sapiens
caaaaccatcgaccgttgattgtacc

SEQ ID NO: 7957 - DNA, 24 bp, Homo sapiens
gtagaggagatggcgcaggggaca

SEQ ID NO: 7958 - DNA, 27 bp, Homo sapiens
ctgagaactgaattccataggctgtga

SEQ ID NO: 7959 - DNA, 25 bp, Homo sapiens
ttctccaaaagaaagcactttctgt

SEQ ID NO: 7960 - DNA, 23 bp, Homo sapiens
cctccgtgttacctgtcctctag

SEQ ID NO: 7961 - DNA, 23 bp, Homo sapiens
aaagtgcttcctttttgagggtt

SEQ ID NO: 7962 - DNA, 23 bp, Homo sapiens
aaactagtaatgttggattaggg

SEQ ID NO: 7963 - DNA, 23 bp, Homo sapiens
aaagtgcatctttttagaggatt

SEQ ID NO: 7964 - DNA, 23 bp, Homo sapiens
tgggtctttgcgggcgagatgag

SEQ ID NO: 7965 - DNA, 23 bp, Homo sapiens
tcagtaacaaagattcatccttg

SEQ ID NO: 7966 - DNA, 22 bp, Homo sapiens
gctctgacgaggttgcactact

SEQ ID NO: 7967 - DNA, 24 bp, Homo sapiens
gaacgcgcttccctatagagggtt

SEQ ID NO: 7968 - DNA, 23 bp, Homo sapiens
attaggccgcagatctgggtgaa

SEQ ID NO: 7969 - DNA, 25 bp, Homo sapiens
acaaagtgcctccctttagagtgtt

SEQ ID NO: 7970 - DNA, 25 bp, Homo sapiens
agaaagcgcttccctttgctggatt

SEQ ID NO: 7971 - DNA, 22 bp, Homo sapiens
cctctaaagggaagcgctttct

SEQ ID NO: 7972 - DNA, 32 bp, Homo sapiens
gtcgggaaaagctgggttgagaggrbrraaaa

SEQ ID NO: 7973 - DNA, 29 bp, Homo sapiens
caacattcattgctgtcggtgggttkaac

SEQ ID NO: 7974 - DNA, 24 bp, Homo sapiens
tttcaagccagggggcgtttttct

SEQ ID NO: 7975 - DNA, 23 bp, Homo sapiens
ctgcaaagggaagccctttctgt

SEQ ID NO: 7976 - DNA, 23 bp, Homo sapiens
agcgaggttgccctttgtatatt

SEQ ID NO: 7977 - DNA, 21 bp, Homo sapiens
cagtggccagagccctgcagt

SEQ ID NO: 7978 - DNA, 22 bp, Homo sapiens
aaaagtaatcactgtttttgcc

SEQ ID NO: 7979 - DNA, 25 bp, Homo sapiens
cacaaatctccggaccacttagtct

SEQ ID NO: 7980 - DNA, 23 bp, Homo sapiens
gcagccacaactaccctgccact

SEQ ID NO: 7981 - DNA, 25 bp, Homo sapiens
acaaagtgcttccctttagagtktt

SEQ ID NO: 7982 - DNA, 21 bp, Homo sapiens
attgacacctctgtgagtgga

SEQ ID NO: 7983 - DNA, 24 bp, Homo sapiens
ctccagagggaagcgctttctgtt

SEQ ID NO: 7984 - DNA, 22 bp, Homo sapiens
tgtgttgcatgtgtgtatatgt

SEQ ID NO: 7985 - DNA, 26 bp, Homo sapiens
cctgtaacagcaactccatgtggamk

SEQ ID NO: 7986 - DNA, 23 bp, Homo sapiens
ctacaaagggaagcactttctct

SEQ ID NO: 7987 - DNA, 24 bp, Homo sapiens
gaaagcgcttcccttcagagtgtt

SEQ ID NO: 7988 - DNA, 24 bp, Homo sapiens
agagtgccttcttttggagcgtta

SEQ ID NO: 7989 - DNA, 23 bp, Homo sapiens
saaagcgcttctctttagagkrt

SEQ ID NO: 7990 - DNA, 23 bp, Homo sapiens
acaacaacattaaaccacccgat

SEQ ID NO: 7991 - DNA, 23 bp, Homo sapiens
acaacaaatcccagtctacctaa

SEQ ID NO: 7992 - DNA, 25 bp, Homo sapiens
ctagcaccatttgaaatcrgtkwtt

SEQ ID NO: 7993 - DNA, 22 bp, Homo sapiens
tcggctctgggtctgtggggag

SEQ ID NO: 7994 - DNA, 23 bp, Homo sapiens
ttctccaaaagggagcactttct

SEQ ID NO: 7995 - DNA, 26 bp, Homo sapiens
ctgaggtagtagtttgtrcwgttkgt

SEQ ID NO: 7996 - DNA, 24 bp, Homo sapiens
tctacaaaggaaagcgctttctgt

SEQ ID NO: 7997 - DNA, 22 bp, Homo sapiens
atatacagggggagactcttat

SEQ ID NO: 7998 - DNA, 23 bp, Homo sapiens
catctgatatacaatattttctt

SEQ ID NO: 7999 - DNA, 24 bp, Homo sapiens
agggacgggacgcggtgcagtgtt

SEQ ID NO: 8000 - DNA, 24 bp, Homo sapiens
aaactaatctctacactgctgccc

SEQ ID NO: 8001 - DNA, 25 bp, Homo sapiens
tggagttaggattaggtcgtggaag

SEQ ID NO: 8002 - DNA, 23 bp, Homo sapiens
tcacctgacctcccatgcctgtg

SEQ ID NO: 8003 - DNA, 21 bp, Homo sapiens
atcacattgccagtgattacc

SEQ ID NO: 8004 - DNA, 22 bp, Homo sapiens
agaccctggtctgcactctatc

SEQ ID NO: 8005 - DNA, 22 bp, Homo sapiens
aaacatggttccgtcaagcacc

SEQ ID NO: 8006 - DNA, 25 bp, Homo sapiens
ggaatctgtgctctgggggctgtgc

SEQ ID NO: 8007 - DNA, 23 bp, Homo sapiens
tcagtaacaaagattcatccttg

SEQ ID NO: 8008 - DNA, 23 bp, Homo sapiens
tgattgaaacctctaagagtgga

SEQ ID NO: 8009 - DNA, 22 bp, Homo sapiens
aggaccttccctgaaccaagga

SEQ ID NO: 8010 - DNA, 25 bp, Homo sapiens
taggtagtttcctgttgttgggatc

SEQ ID NO: 8011 - DNA, 21 bp, Homo sapiens
ttgaaaggctatttcttggtc

SEQ ID NO: 8012 - DNA, 23 bp, Homo sapiens
cacgggttaggctcttgggagct

SEQ ID NO: 8013 - DNA, 23 bp, Homo sapiens
tactgcaatgtaagcacttctta

SEQ ID NO: 8014 - DNA, 23 bp, Homo sapiens
aagtcattggagggtttgagcag

SEQ ID NO: 8015 - DNA, 24 bp, Homo sapiens
csaargcgcttccctttrgagygt

SEQ ID NO: 8016 - DNA, 23 bp, Homo sapiens
catcagaattcatggaggctaga

SEQ ID NO: 8017 - DNA, 24 bp, Homo sapiens
aagctacagttacttttgcaccag

SEQ ID NO: 8018 - DNA, 22 bp, Homo sapiens
gtgacatcacatatacggcagc

SEQ ID NO: 8019 - DNA, 23 bp, Homo sapiens
tccctgagaccctaacttgtgak

SEQ ID NO: 8020 - DNA, 22 bp, Homo sapiens
tgggcgtatctgtatgctaggg

SEQ ID NO: 8021 - DNA, 22 bp, Homo sapiens
tcagttccaggccaaccaggct

SEQ ID NO: 8022 - DNA, 23 bp, Homo sapiens
catcaaggatcttaaactttgcc

SEQ ID NO: 8023 - DNA, 22 bp, Homo sapiens
aacgcacttccctttagagtgt

SEQ ID NO: 8024 - DNA, 23 bp, Homo sapiens
tggtgcggagagggcccacagtg

SEQ ID NO: 8025 - DNA, 23 bp, Homo sapiens
ctacaaagggaagccctttctgt

SEQ ID NO: 8026 - DNA, 24 bp, Homo sapiens
gtagaggagatggcgcaggggaca

SEQ ID NO: 8027 - DNA, 23 bp, Homo sapiens
aaactctacttgtccttctgagt

SEQ ID NO: 8028 - DNA, 31 bp, Homo sapiens
tcatggcaacaccagtcgatgggctgtctga

SEQ ID NO: 8029 - DNA, 22 bp, Homo sapiens
tagtcccttccttgaagcggtc

SEQ ID NO: 8030 - DNA, 25 bp, Homo sapiens
ttcactggagtttgtttcaatattg

SEQ ID NO: 8031 - DNA, 24 bp, Homo sapiens
caaagtgcctccttttagagtgtt

SEQ ID NO: 8032 - DNA, 22 bp, Homo sapiens
ataggactcatatagtgccagg

SEQ ID NO: 8033 - DNA, 23 bp, Homo sapiens
catcagttcctaatgcattgcct

SEQ ID NO: 8034 - DNA, 25 bp, Homo sapiens
tactgcagtgaaggcacttgtagca

SEQ ID NO: 8035 - DNA, 24 bp, Homo sapiens
cctccaaagggaagcgctttctgt

SEQ ID NO: 8036 - DNA, 29 bp, Homo sapiens
gctmtgacctatgaattgacagmcartgc

SEQ ID NO: 8037 - DNA, 23 bp, Homo sapiens
tgagtattacatggccaatctcc

SEQ ID NO: 8038 - DNA, 22 bp, Homo sapiens
aactggcctacaaagtcccagt

SEQ ID NO: 8039 - DNA, 23 bp, Homo sapiens
aagttgcccgtgtttttttcgct

SEQ ID NO: 8040 - DNA, 24 bp, Homo sapiens
tcaaatgctcagactcctgtggtg

SEQ ID NO: 8041 - DNA, 24 bp, Homo sapiens
tcgaggactggtggaagggccttt

SEQ ID NO: 8042 - DNA, 27 bp, Homo sapiens
taggcagtgtattgctagcggctgtta

SEQ ID NO: 8043 - DNA, 23 bp, Homo sapiens
gtataggcctttagatcatctga

SEQ ID NO: 8044 - DNA, 21 bp, Homo sapiens
gcggggcgccgcgggaccgcc

SEQ ID NO: 8045 - DNA, 30 bp, Homo sapiens
ctcccggacaggcgttcgtgcgacgtgtgg

SEQ ID NO: 8046 - DNA, 24 bp, Homo sapiens
caacaggcggctgtagcaatgggg

SEQ ID NO: 8047 - DNA, 22 bp, Homo sapiens
gagggagggacgggggctgtgc

SEQ ID NO: 8048 - DNA, 23 bp, Homo sapiens
agtgcacccaggcaaggattctg

SEQ ID NO: 8049 - DNA, 24 bp, Homo sapiens
cctccaaagggaagcgctttctgt

SEQ ID NO: 8050 - DNA, 26 bp, Homo sapiens
aagcagcattgtacagggctatsaar

SEQ ID NO: 8051 - DNA, 23 bp, Homo sapiens
agcgctttgctcagccagtgtag

SEQ ID NO: 8052 - DNA, 22 bp, Homo sapiens
ctgataagaacagaggcccaga

SEQ ID NO: 8053 - DNA, 22 bp, Homo sapiens
cccttgggtctgatggggtagc

SEQ ID NO: 8054 - DNA, 23 bp, Homo sapiens
tagcagcacatcatggtttacat

SEQ ID NO: 8055 - DNA, 22 bp, Homo sapiens
tacttggaaaggcatcagttgc

SEQ ID NO: 8056 - DNA, 23 bp, Homo sapiens
cagcccggatcccagcccactta

SEQ ID NO: 8057 - DNA, 24 bp, Homo sapiens
aaagtgctgtcatagctgaggtcc

SEQ ID NO: 8058 - DNA, 23 bp, Homo sapiens
atattgcacattactaagttgca

SEQ ID NO: 8059 - DNA, 22 bp, Homo sapiens
tcagtgcatcacagaactttgt

SEQ ID NO: 8060 - DNA, 21 bp, Homo sapiens
aggcggagacttgggcaattg

SEQ ID NO: 8061 - DNA, 24 bp, Homo sapiens
ctcgtaccgtgagtaataatgcgc

SEQ ID NO: 8062 - DNA, 22 bp, Homo sapiens
ggtcgtatgtgtgacgccattt

SEQ ID NO: 8063 - DNA, 23 bp, Homo sapiens
agcgctttgctcagccagtgtag

SEQ ID NO: 8064 - DNA, 23 bp, Homo sapiens
gcagagaacaaaggactcagtaa

SEQ ID NO: 8065 - DNA, 24 bp, Homo sapiens
ctcacagtgaaccggtctctttyy

SEQ ID NO: 8066 - DNA, 22 bp, Homo sapiens
tagtaccagtaccttgtgttca

SEQ ID NO: 8067 - DNA, 24 bp, Homo sapiens
ttctgggtggtctggagatttgtg

SEQ ID NO: 8068 - DNA, 24 bp, Homo sapiens
ttggggaaacggccgctgagtgag

SEQ ID NO: 8069 - DNA, 22 bp, Homo sapiens
gtagattttccttctatggtta

SEQ ID NO: 8070 - DNA, 24 bp, Homo sapiens
gaagttgttcgtggtggattcgct

SEQ ID NO: 8071 - DNA, 23 bp, Homo sapiens
ctctcaccactgccctcccacag

SEQ ID NO: 8072 - DNA, 25 bp, Homo sapiens
tactagactgaagctccttgaggac

SEQ ID NO: 8073 - DNA, 23 bp, Homo sapiens
cgagcctcaagcaagggacttca

SEQ ID NO: 8074 - DNA, 23 bp, Homo sapiens
aaaggattctgctgtcggtccca

SEQ ID NO: 8075 - DNA, 23 bp, Homo sapiens
gttgtgtcagtttatcaaaccca

SEQ ID NO: 8076 - DNA, 23 bp, Homo sapiens
agggacttttgggggcagatgtg

SEQ ID NO: 8077 - DNA, 23 bp, Homo sapiens
gagggttgggtggaggctctcct

SEQ ID NO: 8078 - DNA, 24 bp, Homo sapiens
acctggacccagcgtagacaaaga

SEQ ID NO: 8079 - DNA, 25 bp, Homo sapiens
ctgtgcaaatccatgcaaaactgat

SEQ ID NO: 8080 - DNA, 29 bp, Homo sapiens
ccaaagtgctgttcgtgcaggtagtgtga

SEQ ID NO: 8081 - DNA, 23 bp, Homo sapiens
tatacctcagttttatcaggtgt

SEQ ID NO: 8082 - DNA, 21 bp, Homo sapiens
cagtggccagagccctgcagt

SEQ ID NO: 8083 - DNA, 28 bp, Homo sapiens
ggtccagttttcccaggaatcccttaga

SEQ ID NO: 8084 - DNA, 25 bp, Homo sapiens
atgtcactcggctcggcccactacc

SEQ ID NO: 8085 - DNA, 22 bp, Homo sapiens
aggtggtccgtggcgcgttcgc

SEQ ID NO: 8086 - DNA, 26 bp, Homo sapiens
atgattggtacgtctgtgggtagagt

SEQ ID NO: 8087 - DNA, 24 bp, Homo sapiens
tggaaacatttctgcacaaactag

SEQ ID NO: 8088 - DNA, 24 bp, Homo sapiens
gaagttctgttatacactcaggct

SEQ ID NO: 8089 - DNA, 23 bp, Homo sapiens
tgatgggtgaatttgtagaagga

SEQ ID NO: 8090 - DNA, 22 bp, Homo sapiens
tccagtaccacgtgtcagggcc

SEQ ID NO: 8091 - DNA, 25 bp, Homo sapiens
tggagttaggattaggtcgtggaag

SEQ ID NO: 8092 - DNA, 24 bp, Homo sapiens
gggagccaggaagtattgatgttt

SEQ ID NO: 8093 - DNA, 30 bp, Homo sapiens
gaaaaaaccactgaccgttgactgtacctt

SEQ ID NO: 8094 - DNA, 21 bp, Homo sapiens
gtgggttggggcgggctctgg

SEQ ID NO: 8095 - DNA, 24 bp, Homo sapiens
ttatcagaatctccaggggtactt

SEQ ID NO: 8096 - DNA, 22 bp, Homo sapiens
aggcagcggggtgtagtggata

SEQ ID NO: 8097 - DNA, 24 bp, Homo sapiens
aagctcggtctgaggcccctcagt

SEQ ID NO: 8098 - DNA, 24 bp, Homo sapiens
ttgtgacagattgataactgaaag

SEQ ID NO: 8099 - DNA, 21 bp, Homo sapiens
ccctagaatggggattgtggg

SEQ ID NO: 8100 - DNA, 22 bp, Homo sapiens
ctgggagagggttgtttactcc

SEQ ID NO: 8101 - DNA, 25 bp, Homo sapiens
cactggacttggagtcagaaggcct

SEQ ID NO: 8102 - DNA, 23 bp, Homo sapiens
ctgggatctccggggtcttggtt

SEQ ID NO: 8103 - DNA, 22 bp, Homo sapiens
agaggataccctttgtatgttc

SEQ ID NO: 8104 - DNA, 22 bp, Homo sapiens
tgcaggaacttgtgagtctcct

SEQ ID NO: 8105 - DNA, 24 bp, Homo sapiens
aacattcattgttgtcggtgggtt

SEQ ID NO: 8106 - DNA, 22 bp, Homo sapiens
gtggttatccctgtcctgttcg

SEQ ID NO: 8107 - DNA, 23 bp, Homo sapiens
gagggttgggtggaggctctcct

SEQ ID NO: 8108 - DNA, 22 bp, Homo sapiens
ccagtggagatgctgttacttt

SEQ ID NO: 8109 - DNA, 23 bp, Homo sapiens
cctcacacctgcctcgcccccca

SEQ ID NO: 8110 - DNA, 23 bp, Homo sapiens
taaatttcacctttctgagaagg

SEQ ID NO: 8111 - DNA, 23 bp, Homo sapiens
cagtgcaatgatattgtcaaagc

SEQ ID NO: 8112 - DNA, 23 bp, Homo sapiens
cacatggccgaaacagagaagtt

SEQ ID NO: 8113 - DNA, 25 bp, Homo sapiens
aatgcacctgggcaaggattcwgag

SEQ ID NO: 8114 - DNA, 25 bp, Homo sapiens
atgtcactcggctcggcccactacc

SEQ ID NO: 8115 - DNA, 27 bp, Homo sapiens
atggtagactatggaacgtaggcgtta

SEQ ID NO: 8116 - DNA, 23 bp, Homo sapiens
cggccccacgcaccagggtaaga

SEQ ID NO: 8117 - DNA, 23 bp, Homo sapiens
ccccgttcggcgcgcgcgtgcgc

SEQ ID NO: 8118 - DNA, 24 bp, Homo sapiens
agaggtagtaggttgcatagtttt

SEQ ID NO: 8119 - DNA, 24 bp, Homo sapiens
ctgaggagatcgtcgaggttggcc

SEQ ID NO: 8120 - DNA, 23 bp, Homo sapiens
tcggctaacatgcaactgctgtc

SEQ ID NO: 8121 - DNA, 23 bp, Homo sapiens
gtagattctccttctatgagtac

SEQ ID NO: 8122 - DNA, 23 bp, Homo sapiens
agctcatccatagttgtcactgt

SEQ ID NO: 8123 - DNA, 22 bp, Homo sapiens
atacacatacacgcaacacaca

SEQ ID NO: 8124 - DNA, 23 bp, Homo sapiens
agcccctgcccaccgcacactgc

SEQ ID NO: 8125 - DNA, 21 bp, Homo sapiens
acgttggctctggtggtgatg

SEQ ID NO: 8126 - DNA, 22 bp, Homo sapiens
atggccaaaactgcagttattt

SEQ ID NO: 8127 - DNA, 23 bp, Homo sapiens
gtagattctccttctatgagtac

SEQ ID NO: 8128 - DNA, 25 bp, Homo sapiens
agatcgaccgtgttatattcgcttt

SEQ ID NO: 8129 - DNA, 22 bp, Homo sapiens
caaaagtgatcgtggtttttgc

SEQ ID NO: 8130 - DNA, 26 bp, Homo sapiens
accttcttgtataagcactgtgctaa

SEQ ID NO: 8131 - DNA, 24 bp, Homo sapiens
ctcttgagggaagcactttctgtt

SEQ ID NO: 8132 - DNA, 24 bp, Homo sapiens
ttcaagtaattcaggataggttgt

SEQ ID NO: 8133 - DNA, 22 bp, Homo sapiens
gtgggcgggggcaggtgtgtgg

SEQ ID NO: 8134 - DNA, 22 bp, Homo sapiens
taggttatccgtgttgccttcg

SEQ ID NO: 8135 - DNA, 25 bp, Homo sapiens
gtacagtactgtgataactgaagra

SEQ ID NO: 8136 - DNA, 29 bp, Homo sapiens
agaagaaagatctggaagtgggagacact

SEQ ID NO: 8137 - DNA, 20 bp, Homo sapiens
aatggatttttggagcagga

SEQ ID NO: 8138 - DNA, 23 bp, Homo sapiens
cggccccacgcaccagggtaaga

SEQ ID NO: 8139 - DNA, 21 bp, Homo sapiens
gcggggcgccgcgggaccgcc

SEQ ID NO: 8140 - DNA, 23 bp, Homo sapiens
tgtctactactggagacactggt

SEQ ID NO: 8141 - DNA, 24 bp, Homo sapiens
actcaaactgtgggggcactttct

SEQ ID NO: 8142 - DNA, 25 bp, Homo sapiens
gagcctggaagctggagcctgcagt

SEQ ID NO: 8143 - DNA, 23 bp, Homo sapiens
gtgaattaccgaagggccataaa

SEQ ID NO: 8144 - DNA, 27 bp, Homo sapiens
ttctaggtatggtcccagggatcccag

SEQ ID NO: 8145 - DNA, 23 bp, Homo sapiens
tagccttcagatcttggtgtttt

SEQ ID NO: 8146 - DNA, 24 bp, Homo sapiens
agagtgccttcttttggagcgtta

SEQ ID NO: 8147 - DNA, 25 bp, Homo sapiens
tggagttaggattaggtcgtggaag

SEQ ID NO: 8148 - DNA, 22 bp, Homo sapiens
ttctcaagagggaggcaatcat

SEQ ID NO: 8149 - DNA, 22 bp, Homo sapiens
cactgacaggagagcattttga

SEQ ID NO: 8150 - DNA, 25 bp, Homo sapiens
cttccctttgtcatcctwygcctrr

SEQ ID NO: 8151 - DNA, 24 bp, Homo sapiens
acagcagcaattcatgttttgaag

SEQ ID NO: 8152 - DNA, 25 bp, Homo sapiens
tmaaagtgcttacagtgcaggtagy

SEQ ID NO: 8153 - DNA, 23 bp, Homo sapiens
ataatacatggttaacctctttt

SEQ ID NO: 8154 - DNA, 22 bp, Homo sapiens
ttctcaagagggaggcaatcat

SEQ ID NO: 8155 - DNA, 19 bp, Homo sapiens
gtgtgggggagaggctgtc

SEQ ID NO: 8156 - DNA, 24 bp, Homo sapiens
acagcagcaattcatgttttgaag

SEQ ID NO: 8157 - DNA, 23 bp, Homo sapiens
cagtgcaatgatattgtcaaagc

SEQ ID NO: 8158 - DNA, 23 bp, Homo sapiens
tactgcaatgtaagcacttctta

SEQ ID NO: 8159 - DNA, 23 bp, Homo sapiens
atatacaagggcaagctctctgt

SEQ ID NO: 8160 - DNA, 29 bp, Homo sapiens
atataccctgtagatccgaatttgtgtaa

SEQ ID NO: 8161 - DNA, 23 bp, Homo sapiens
ttggccatggggctgcgcggggc

SEQ ID NO: 8162 - DNA, 23 bp, Homo sapiens
actcactgatcaatgaatgcaaa

SEQ ID NO: 8163 - DNA, 23 bp, Homo sapiens
gtgaaggtctactgtgtgccagg

SEQ ID NO: 8164 - DNA, 22 bp, Homo sapiens
gtccctctccaaatgtgtcttg

SEQ ID NO: 8165 - DNA, 22 bp, Homo sapiens
cgcggggatcgccgagggccgg

SEQ ID NO: 8166 - DNA, 23 bp, Homo sapiens
actttaacatggaagtgctttct

SEQ ID NO: 8167 - DNA, 23 bp, Homo sapiens
tttcctcatattcattcaggagt

SEQ ID NO: 8168 - DNA, 25 bp, Homo sapiens
atcatacaaggacaatttctttttg

SEQ ID NO: 8169 - DNA, 21 bp, Homo sapiens
cagtgcctcggcagtgcagcc

SEQ ID NO: 8170 - DNA, 23 bp, Homo sapiens
ccccgttcggcgcgcgcgtgcgc

SEQ ID NO: 8171 - DNA, 22 bp, Homo sapiens
caatcatgtgcagtgccaatat

SEQ ID NO: 8172 - DNA, 21 bp, Homo sapiens
ctatacaatctattgccttcc

SEQ ID NO: 8173 - DNA, 24 bp, Homo sapiens
aacattcattgttgtcggtgggtt

SEQ ID NO: 8174 - DNA, 25 bp, Homo sapiens
aactgtttgcagaggaaactgagac

SEQ ID NO: 8175 - DNA, 22 bp, Homo sapiens
agaggataccctttgtatgttc

SEQ ID NO: 8176 - DNA, 25 bp, Homo sapiens
tagcagcacgtaaatattggcgtwg

SEQ ID NO: 8177 - DNA, 23 bp, Homo sapiens
aaccatcgaccgttgagtggacc

SEQ ID NO: 8178 - DNA, 25 bp, Homo sapiens
aaacccgtagatccgaacttgtggt

SEQ ID NO: 8179 - DNA, 31 bp, Homo sapiens
ttttggcaatggtagaactcacactggtgag

SEQ ID NO: 8180 - DNA, 25 bp, Homo sapiens
tgtaaacatcctcgactggaagctg

SEQ ID NO: 8181 - DNA, 22 bp, Homo sapiens
tccttgggagccctgttagact

SEQ ID NO: 8182 - DNA, 30 bp, Homo sapiens
tggctcccacttccagatctttctctctgt

SEQ ID NO: 8183 - DNA, 22 bp, Homo sapiens
gagactgatgagttcccgggaa

SEQ ID NO: 8184 - DNA, 26 bp, Homo sapiens
tgtaaacatccttgactggaagctgt

SEQ ID NO: 8185 - DNA, 24 bp, Homo sapiens
caaagaattctccttttgggcttt

SEQ ID NO: 8186 - DNA, 23 bp, Homo sapiens
caccgcggtcttttcctcccact

SEQ ID NO: 8187 - DNA, 23 bp, Homo sapiens
ccttatcacttttccagcccagc

SEQ ID NO: 8188 - DNA, 24 bp, Homo sapiens
actgctgagctagcacttcccgag

SEQ ID NO: 8189 - DNA, 26 bp, Homo sapiens
ctgaggtagtagtttgtrcwgttkgt

SEQ ID NO: 8190 - DNA, 23 bp, Homo sapiens
gactccagttttagttctcttgc

SEQ ID NO: 8191 - DNA, 21 bp, Homo sapiens
caaattcgtatctaggggaat

SEQ ID NO: 8192 - DNA, 23 bp, Homo sapiens
gtcagtgcatgacagaacttggg

SEQ ID NO: 8193 - DNA, 22 bp, Homo sapiens
atatagggattggagccgtggc

SEQ ID NO: 8194 - DNA, 25 bp, Homo sapiens
tactgccctaaatgccccttctggc

SEQ ID NO: 8195 - DNA, 25 bp, Homo sapiens
tmaaagtgcttacagtgcaggtagy

SEQ ID NO: 8196 - DNA, 22 bp, Homo sapiens
aattgcactttagcaatggtga

SEQ ID NO: 8197 - DNA, 24 bp, Homo sapiens
agagtgccttcttttggagcgtta

SEQ ID NO: 8198 - DNA, 22 bp, Homo sapiens
cttggcacctagcaagcactca

SEQ ID NO: 8199 - DNA, 23 bp, Homo sapiens
tcgaggagctcacagtctagtat

SEQ ID NO: 8200 - DNA, 24 bp, Homo sapiens
tgggaacgggttccggcagacgct

SEQ ID NO: 8201 - DNA, 23 bp, Homo sapiens
ctacaaagggaagccctttctgt

SEQ ID NO: 8202 - DNA, 24 bp, Homo sapiens
aacattcattgttgtcggtgggtt

SEQ ID NO: 8203 - DNA, 21 bp, Homo sapiens
ccagtcctgtgcctgccgcct

SEQ ID NO: 8204 - DNA, 23 bp, Homo sapiens
aaagtgcttcctttttgagggtt

SEQ ID NO: 8205 - DNA, 22 bp, Homo sapiens
ggtcgtatgtgtgacgccattt

SEQ ID NO: 8206 - DNA, 23 bp, Homo sapiens
atgtagggctaaaagccatgggc

SEQ ID NO: 8207 - DNA, 23 bp, Homo sapiens
agttttgcaggtttgcatccagc

SEQ ID NO: 8208 - DNA, 25 bp, Homo sapiens
taggtagtttcctgttgttgggatc

SEQ ID NO: 8209 - DNA, 29 bp, Homo sapiens
gctmtgacctatgaattgacagmcartgc

SEQ ID NO: 8210 - DNA, 25 bp, Homo sapiens
cagctacattgtctgctgggtttca

SEQ ID NO: 8211 - DNA, 26 bp, Homo sapiens
actggctcagttcagcaggaacagga

SEQ ID NO: 8212 - DNA, 25 bp, Homo sapiens
caacggaatcccaaaagcagctgtt

SEQ ID NO: 8213 - DNA, 23 bp, Homo sapiens
ctatacgacctgctgcctttctt

SEQ ID NO: 8214 - DNA, 28 bp, Homo sapiens
agtctgagatgaagcactgtagctcagg

SEQ ID NO: 8215 - DNA, 26 bp, Homo sapiens
agtcagtgcactacagaactttgtct

SEQ ID NO: 8216 - DNA, 25 bp, Homo sapiens
aaagctgccagttgaagaactgttg

SEQ ID NO: 8217 - DNA, 25 bp, Homo sapiens
cttcaccaccttctccacccagcat

SEQ ID NO: 8218 - DNA, 25 bp, Homo sapiens
ctgaggtaggaggttgtatagttga

SEQ ID NO: 8219 - DNA, 29 bp, Homo sapiens
atgaggtagtagattgtatagttktgggg

SEQ ID NO: 8220 - DNA, 25 bp, Homo sapiens
ctagcaccatctgaaatcggttata

SEQ ID NO: 8221 - DNA, 24 bp, Homo sapiens
ccacccgtagaaccgaccttgcgg

SEQ ID NO: 8222 - DNA, 28 bp, Homo sapiens
tgrgctttcagtcggatgtttrcagckg

SEQ ID NO: 8223 - DNA, 23 bp, Homo sapiens
gttcacagtggctaagttcygcm

SEQ ID NO: 8224 - DNA, 26 bp, Homo sapiens
gtattgcacttgtcccggcctgtkga

SEQ ID NO: 8225 - DNA, 26 bp, Homo sapiens
aagcagcattgtacagggctatsaar

SEQ ID NO: 8226 - DNA, 25 bp, Homo sapiens
actcggcgtggcgtcggtcgtggta

SEQ ID NO: 8227 - DNA, 25 bp, Homo sapiens
gcattgcacttgtctcggtctgaca

SEQ ID NO: 8228 - DNA, 25 bp, Homo sapiens
aatcacattgccagggattwccams

SEQ ID NO: 8229 - DNA, 27 bp, Homo sapiens
taccacagggtagaaccacggacagga

SEQ ID NO: 8230 - DNA, 27 bp, Homo sapiens
ttgtaaacatccccgactggaagctgt

SEQ ID NO: 8231 - DNA, 25 bp, Homo sapiens
taccgcactgtgggtacttgctgct

SEQ ID NO: 8232 - DNA, 27 bp, Homo sapiens
  modified_base (26)..(26): a, c, t, or g
gdtgaggtagtaggttgtrtrgtttng

SEQ ID NO: 8233 - DNA, 27 bp, Homo sapiens
ccatgccttgagtgtaggaccgttggc

SEQ ID NO: 8234 - DNA, 30 bp, Homo sapiens
gaacattcaacgctgtcggtgagtttggga

SEQ ID NO: 8235 - DNA, 25 bp, Homo sapiens
ccactagattgtgagctcctggagg

SEQ ID NO: 8236 - DNA, 29 bp, Homo sapiens
attcaagtaatccaggataggctgtkyag

SEQ ID NO: 8237 - DNA, 29 bp, Homo sapiens
ccaaagtgctgttcgtgcaggtagtgtga

SEQ ID NO: 8238 - DNA, 29 bp, Homo sapiens
gtagcttatcagactgatgttgactgttg

SEQ ID NO: 8239 - DNA, 25 bp, Homo sapiens
tgtaaacatcctacactctcwgctg

SEQ ID NO: 8240 - DNA, 28 bp, Homo sapiens
ataccctgtagaaccgaatttgtgtggt

SEQ ID NO: 8241 - DNA, 25 bp, Homo sapiens
ctcgtgtcttgtgttgcagccggag

SEQ ID NO: 8242 - DNA, 22 bp, Homo sapiens
atacacatacacgcaacacaca

SEQ ID NO: 8243 - DNA, 23 bp, Homo sapiens
cactggacttggagtcagaagag

SEQ ID NO: 8244 - DNA, 24 bp, Homo sapiens
tcaaatgctcagactcctgtggtg

SEQ ID NO: 8245 - DNA, 23 bp, Homo sapiens
agggactttcaggggcagctgtg

SEQ ID NO: 8246 - DNA, 25 bp, Homo sapiens
ttggcagtgtcttagctggttgttg

SEQ ID NO: 8247 - DNA, 24 bp, Homo sapiens
tactcaaaatgggggcgctttcct

SEQ ID NO: 8248 - DNA, 24 bp, Homo sapiens
ctgaggagatcgtcgaggttggcc

SEQ ID NO: 8249 - DNA, 24 bp, Homo sapiens
tcagaacaaatgccggttcccaga

SEQ ID NO: 8250 - DNA, 22 bp, Homo sapiens
tttaggataagcttgacttttg

SEQ ID NO: 8251 - DNA, 24 bp, Homo sapiens
cagttgctagttgcactcctctct

SEQ ID NO: 8252 - DNA, 26 bp, Homo sapiens
cccatccgcgctctgactctctgccc

SEQ ID NO: 8253 - DNA, 22 bp, Homo sapiens
cttagcaggttgtattatcatt

SEQ ID NO: 8254 - DNA, 22 bp, Homo sapiens
aggtggtccgtggcgcgttcgc

SEQ ID NO: 8255 - DNA, 25 bp, Homo sapiens
tcaaacgccattatcacactaaata

SEQ ID NO: 8256 - DNA, 20 bp, Homo sapiens
ccccagggcgacgcggcggg

SEQ ID NO: 8257 - DNA, 22 bp, Homo sapiens
gtacttcacctggtccactagc

SEQ ID NO: 8258 - DNA, 22 bp, Homo sapiens
gtacttcacctggtccactagc

SEQ ID NO: 8259 - DNA, 22 bp, Homo sapiens
ctcactgaacaatgaatgcaac

SEQ ID NO: 8260 - DNA, 25 bp, Homo sapiens
gcattgcacttgtctcggtctgaca

SEQ ID NO: 8261 - DNA, 24 bp, Homo sapiens
ctccagagggaagcgctttctgtt

SEQ ID NO: 8262 - DNA, 24 bp, Homo sapiens
gaggccccgcgcgtgtgtcccggc

SEQ ID NO: 8263 - DNA, 23 bp, Homo sapiens
catctgatatacaatattttctt

SEQ ID NO: 8264 - DNA, 26 bp, Homo sapiens
tgattaatatcggacaaccattgttt

SEQ ID NO: 8265 - DNA, 23 bp, Homo sapiens
cctgggcagcgtgtggctgaagg

SEQ ID NO: 8266 - DNA, 24 bp, Homo sapiens
gggagccaggaagtattgatgttt

SEQ ID NO: 8267 - DNA, 27 bp, Homo sapiens
ccatgccttgagtgtaggaccgttggc

SEQ ID NO: 8268 - DNA, 22 bp, Homo sapiens
tcaccctgcatcccgcacccag

SEQ ID NO: 8269 - DNA, 24 bp, Homo sapiens
ttgcatagtcacaaaagtgatcat

SEQ ID NO: 8270 - DNA, 29 bp, Homo sapiens
attcaagtaatccaggataggctgtkyag

SEQ ID NO: 8271 - DNA, 25 bp, Homo sapiens
aactgtttgcagaggaaactgagac

SEQ ID NO: 8272 - DNA, 22 bp, Homo sapiens
caccttgccttgctgcccgggc

SEQ ID NO: 8273 - DNA, 21 bp, Homo sapiens
gggttcctggcatgctgattt

SEQ ID NO: 8274 - DNA, 23 bp, Homo sapiens
ccagtggggctgctgttatctgg

SEQ ID NO: 8275 - DNA, 27 bp, Homo sapiens
tgtccttcattccaccggagtctgtct

SEQ ID NO: 8276 - DNA, 28 bp, Homo sapiens
tccatcttccagtacagtgttggatggt

SEQ ID NO: 8277 - DNA, 24 bp, Homo sapiens
ggctgccaattccataggtcacag

SEQ ID NO: 8278 - DNA, 24 bp, Homo sapiens
acagattcgattctaggggaatat

SEQ ID NO: 8279 - DNA, 23 bp, Homo sapiens
cctcctgccctccttgctgtaga

SEQ ID NO: 8280 - DNA, 23 bp, Homo sapiens
tccattacactaccctgcctctt

SEQ ID NO: 8281 - DNA, 23 bp, Homo sapiens
tcagtaacaaagattcatccttg

SEQ ID NO: 8282 - DNA, 25 bp, Homo sapiens
caagtcactagtggttccgtttagt

SEQ ID NO: 8283 - DNA, 23 bp, Homo sapiens
aacacacctattcaaggattcaa

SEQ ID NO: 8284 - DNA, 23 bp, Homo sapiens
cacccgtcccgttcgtccccgga

SEQ ID NO: 8285 - DNA, 23 bp, Homo sapiens
ttaagacttgcagtgatgtttaa

SEQ ID NO: 8286 - DNA, 25 bp, Homo sapiens
actgtgcgtgtgacagcggctgatc

SEQ ID NO: 8287 - DNA, 28 bp, Homo sapiens
atgcaccatggttgtctgagcatgcagc

SEQ ID NO: 8288 - DNA, 24 bp, Homo sapiens
ctgccctggcccgagggaccgact

SEQ ID NO: 8289 - DNA, 23 bp, Homo sapiens
tccctgagaccctaacttgtgak

SEQ ID NO: 8290 - DNA, 26 bp, Homo sapiens
gtcttaccagacatggttagacctgg

SEQ ID NO: 8291 - DNA, 25 bp, Homo sapiens
tcaaacgccattatcacactaaata

SEQ ID NO: 8292 - DNA, 24 bp, Homo sapiens
aaaatctctgcaggcaaatgtgat

SEQ ID NO: 8293 - DNA, 24 bp, Homo sapiens
aatcactaaccacacggccaggta

SEQ ID NO: 8294 - DNA, 26 bp, Homo sapiens
accccgggaacgtcgagactggagcg

SEQ ID NO: 8295 - DNA, 23 bp, Homo sapiens
atgtagggctaaaagccatgggc

SEQ ID NO: 8296 - DNA, 23 bp, Homo sapiens
ctcagtctcatctgcaaagaagt

SEQ ID NO: 8297 - DNA, 26 bp, Homo sapiens
caccaacctggaggactccatgctgt

SEQ ID NO: 8298 - DNA, 22 bp, Homo sapiens
cacgctcatgcacacacccaca

SEQ ID NO: 8299 - DNA, 23 bp, Homo sapiens
tgcctgtctacacttgctgtgca

SEQ ID NO: 8300 - DNA, 26 bp, Homo sapiens
ctgaggtagtagtttgtrcwgttkgt

SEQ ID NO: 8301 - DNA, 21 bp, Homo sapiens
gtgtgcggaaatgcttctgct

SEQ ID NO: 8302 - DNA, 24 bp, Homo sapiens
gtttttcattattgctcctgacct

SEQ ID NO: 8303 - DNA, 25 bp, Homo sapiens
ttaatctcagctggcaactgtgaga

SEQ ID NO: 8304 - DNA, 21 bp, Homo sapiens
caaattcgtatctaggggaat

SEQ ID NO: 8305 - DNA, 25 bp, Homo sapiens
taggtagtttcctgttgttgggatc

SEQ ID NO: 8306 - DNA, 24 bp, Homo sapiens
tcgaccggacctcgaccggctcgt

SEQ ID NO: 8307 - DNA, 26 bp, Homo sapiens
tgaaaatgatgagtagtgactgatga

SEQ ID NO: 8308 - DNA, 23 bp, Homo sapiens
atcaacagacattaattgggcgc

SEQ ID NO: 8309 - DNA, 22 bp, Homo sapiens
ttcaacgggtatttattgagca

SEQ ID NO: 8310 - DNA, 22 bp, Homo sapiens
atgctgacatatttactagagg

SEQ ID NO: 8311 - DNA, 25 bp, Homo sapiens
aatcgtacagggtcatccacttttt

SEQ ID NO: 8312 - DNA, 24 bp, Homo sapiens
tgaggggcagagagcgagactttt

SEQ ID NO: 8313 - DNA, 24 bp, Homo sapiens
tcaagagcaataacgaaaaatgtt

SEQ ID NO: 8314 - DNA, 23 bp, Homo sapiens
agagttgagtctggacgtcccga

SEQ ID NO: 8315 - DNA, 22 bp, Homo sapiens
gctctgactttattgcactact

SEQ ID NO: 8316 - DNA, 23 bp, Homo sapiens
ctgagacctctgggttctgagct

SEQ ID NO: 8317 - DNA, 24 bp, Homo sapiens
aatgcacccgggcaaggattctga

SEQ ID NO: 8318 - DNA, 24 bp, Homo sapiens
tttgtgacctggtccactaaccct

SEQ ID NO: 8319 - DNA, 24 bp, Homo sapiens
catctcactgtagcctcgaacccc

SEQ ID NO: 8320 - DNA, 24 bp, Homo sapiens
aagctcggtctgaggcccctcagt

SEQ ID NO: 8321 - DNA, 25 bp, Homo sapiens
aggttacccgagcaactttgcatct

SEQ ID NO: 8322 - DNA, 23 bp, Homo sapiens
agtggttcttaacagttcaacag

SEQ ID NO: 8323 - DNA, 23 bp, Homo sapiens
ctgtcgattggacccgccctccg

SEQ ID NO: 8324 - DNA, 25 bp, Homo sapiens
atggaatgtaaggaagtgtgtggtt

SEQ ID NO: 8325 - DNA, 27 bp, Homo sapiens
tgctgaagctcagagggctctgattca

SEQ ID NO: 8326 - DNA, 26 bp, Homo sapiens
mtctttggttatctagctgtatgagt

SEQ ID NO: 8327 - DNA, 23 bp, Homo sapiens
aaccatcgaccgttgagtggacc

SEQ ID NO: 8328 - DNA, 24 bp, Homo sapiens
acagcagcaattcatgttttgaag

SEQ ID NO: 8329 - DNA, 24 bp, Homo sapiens
tcaggctcagtcccctcccgataa

SEQ ID NO: 8330 - DNA, 22 bp, Homo sapiens
caggggctggctttcctctggt

SEQ ID NO: 8331 - DNA, 24 bp, Homo sapiens
actgctgagctagcacttcccgag

SEQ ID NO: 8332 - DNA, 21 bp, Homo sapiens
atcacattgccagtgattacc

SEQ ID NO: 8333 - DNA, 24 bp, Homo sapiens
gaagttgttcgtggtggattcgct

SEQ ID NO: 8334 - DNA, 24 bp, Homo sapiens
tgccctgtggactcagttctggtg

SEQ ID NO: 8335 - DNA, 24 bp, Homo sapiens
ctgaggagatcgtcgaggttggcc

SEQ ID NO: 8336 - DNA, 28 bp, Homo sapiens
caaagttctgagacactccgactctgag

SEQ ID NO: 8337 - DNA, 26 bp, Homo sapiens
gccatagcccggtcgctggtacatga

SEQ ID NO: 8338 - DNA, 22 bp, Homo sapiens
actccagccccacagcctcagc

SEQ ID NO: 8339 - DNA, 22 bp, Homo sapiens
agggggaaagttctatagtcct

SEQ ID NO: 8340 - DNA, 23 bp, Homo sapiens
atagtagaccgtatagcgtacgc

SEQ ID NO: 8341 - DNA, 24 bp, Homo sapiens
gagcctctaagaagttgactgaag

SEQ ID NO: 8342 - DNA, 22 bp, Homo sapiens
ctcctacatattagcattaaca

SEQ ID NO: 8343 - DNA, 22 bp, Homo sapiens
tttccggctcgcgtgggtgtgt

SEQ ID NO: 8344 - DNA, 29 bp, Homo sapiens
caacattcattgctgtcggtgggttkaac

SEQ ID NO: 8345 - DNA, 23 bp, Homo sapiens
accaatattactgtgctgcttta

SEQ ID NO: 8346 - DNA, 24 bp, Homo sapiens
aaacccgtagatccgatcttgtgg

SEQ ID NO: 8347 - DNA, 24 bp, Homo sapiens
ggtgcctactgagctgatatcagt

SEQ ID NO: 8348 - DNA, 23 bp, Homo sapiens
atatacaagggcaagctctctgt

SEQ ID NO: 8349 - DNA, 23 bp, Homo sapiens
ataatacatggttaacctctttt

SEQ ID NO: 8350 - DNA, 23 bp, Homo sapiens
ccagttaccgcttccgctaccgc

SEQ ID NO: 8351 - DNA, 23 bp, Homo sapiens
ctaatactgtctggtaaaaccgt

SEQ ID NO: 8352 - DNA, 25 bp, Homo sapiens
attgtgtcaatatgcgatgatgtgt

SEQ ID NO: 8353 - DNA, 25 bp, Homo sapiens
cggggccgtagcactgtctgagagg

SEQ ID NO: 8354 - DNA, 25 bp, Homo sapiens
ggaagcccttaccccaaaaagyatt

SEQ ID NO: 8355 - DNA, 26 bp, Homo sapiens
cacaactagactgtgagcttctagag

SEQ ID NO: 8356 - DNA, 26 bp, Homo sapiens
aggactccatttgttttgatgatgga

SEQ ID NO: 8357 - DNA, 22 bp, Homo sapiens
ctcgtgggctctggccacggcc

SEQ ID NO: 8358 - DNA, 23 bp, Homo sapiens
agaggttgcccttggtgaattcg

SEQ ID NO: 8359 - DNA, 26 bp, Homo sapiens
atccccagatacaatggacaatatgc

SEQ ID NO: 8360 - DNA, 23 bp, Homo sapiens
ctgtacaaccttctagctttcct

SEQ ID NO: 8361 - DNA, 25 bp, Homo sapiens
gtatgtgcctttggactacatcgtg

SEQ ID NO: 8362 - DNA, 23 bp, Homo sapiens
ccaacaatatcctggtgctgagt

SEQ ID NO: 8363 - DNA, 23 bp, Homo sapiens
catcgggaatgtcgtgtccgccc

SEQ ID NO: 8364 - DNA, 23 bp, Homo sapiens
tgtctactactggagacactggt

SEQ ID NO: 8365 - DNA, 23 bp, Homo sapiens
aaggcagggcccccgctccccgg

SEQ ID NO: 8366 - DNA, 25 bp, Homo sapiens
tacccattgcatatcggagttgtga

SEQ ID NO: 8367 - DNA, 25 bp, Homo sapiens
tgtctcccaacccttgtaccagtgc

SEQ ID NO: 8368 - DNA, 22 bp, Homo sapiens
cctggtacaggcctgggggaca

SEQ ID NO: 8369 - DNA, 23 bp, Homo sapiens
attctaatttctccacgtctttg

SEQ ID NO: 8370 - DNA, 23 bp, Homo sapiens
acaacaacattaaaccacccgat

SEQ ID NO: 8371 - DNA, 25 bp, Homo sapiens
tggaagactagtgattttgttgttg

SEQ ID NO: 8372 - DNA, 24 bp, Homo sapiens
ggatatcatcatatactgtaagtt

SEQ ID NO: 8373 - DNA, 26 bp, Homo sapiens
cccatccgcgctctgactctctgccc

SEQ ID NO: 8374 - DNA, 24 bp, Homo sapiens
aaagtgctgcgacatttgagcgtc

SEQ ID NO: 8375 - DNA, 26 bp, Homo sapiens
atgattggtacgtctgtgggtagagt

SEQ ID NO: 8376 - DNA, 24 bp, Homo sapiens
atattgcactcgtcccggcctccg

SEQ ID NO: 8377 - DNA, 23 bp, Homo sapiens
cctcagggctgtagaacagggct

SEQ ID NO: 8378 - DNA, 24 bp, Homo sapiens
tggaaacatttctgcacaaactag

SEQ ID NO: 8379 - DNA, 25 bp, Homo sapiens
tttggtccccttcaaccagctryag

SEQ ID NO: 8380 - DNA, 21 bp, Homo sapiens
ctatacaacctactgccttcc

SEQ ID NO: 8381 - DNA, 25 bp, Homo sapiens
atggtcgaccagttggaaagtaatt

SEQ ID NO: 8382 - DNA, 23 bp, Homo sapiens
tacagcaggcacagacaggcagt

SEQ ID NO: 8383 - DNA, 23 bp, Homo sapiens
gtgaaggtctactgtgtgccagg

SEQ ID NO: 8384 - DNA, 23 bp, Homo sapiens
ttagggccctggctccatctcct

SEQ ID NO: 8385 - DNA, 23 bp, Homo sapiens
tctgtcatttctttaggccaata

SEQ ID NO: 8386 - DNA, 25 bp, Homo sapiens
tggagtgtgacaatggtgtttgtgt

SEQ ID NO: 8387 - DNA, 24 bp, Homo sapiens
actgtacagcctcctagctttcct

SEQ ID NO: 8388 - DNA, 24 bp, Homo sapiens
ttgcatagtcacaaaagtgatcat

SEQ ID NO: 8389 - DNA, 27 bp, Homo sapiens
ttgtaactggttgaacaactgaaccca

SEQ ID NO: 8390 - DNA, 27 bp, Homo sapiens
gaggtgcagtgctgcatctctggtcag

SEQ ID NO: 8391 - DNA, 22 bp, Homo sapiens
ttttgcgatgtgttcctaatat

SEQ ID NO: 8392 - DNA, 22 bp, Homo sapiens
ggggttcctggggatgggattt

SEQ ID NO: 8393 - DNA, 21 bp, Homo sapiens
ctatacaatctattgccttcc

SEQ ID NO: 8394 - DNA, 25 bp, Homo sapiens
actggagatatggaagagctgtgtt

SEQ ID NO: 8395 - DNA, 23 bp, Homo sapiens
tgagaaccacgtctgctctgagc

SEQ ID NO: 8396 - DNA, 24 bp, Homo sapiens
ttctcgaggaaagaagcactttct

SEQ ID NO: 8397 - DNA, 25 bp, Homo sapiens
cttccctttgtcatcctwygcctrr

SEQ ID NO: 8398 - DNA, 22 bp, Homo sapiens
ccagtattaactgtgctgctga

SEQ ID NO: 8399 - DNA, 21 bp, Homo sapiens
gcgacccactcttggtttcca

SEQ ID NO: 8400 - DNA, 23 bp, Homo sapiens
cagtggttttaccctatggtagg

SEQ ID NO: 8401 - DNA, 22 bp, Homo sapiens
ttctcaagagggaggcaatcat

SEQ ID NO: 8402 - DNA, 24 bp, Homo sapiens
aggcaagatgctggcatagctgtt

SEQ ID NO: 8403 - DNA, 22 bp, Homo sapiens
cggggttttgagggcgagatga

SEQ ID NO: 8404 - DNA, 22 bp, Homo sapiens
gtccctctccaaatgtgtcttg

SEQ ID NO: 8405 - DNA, 25 bp, Homo sapiens
ttgcaggtcgtcttgcagggcttct

SEQ ID NO: 8406 - DNA, 22 bp, Homo sapiens
catcccttgcatggtggagggt

SEQ ID NO: 8407 - DNA, 25 bp, Homo sapiens
ctcctgactccaggtcctgtgtgtt

SEQ ID NO: 8408 - DNA, 22 bp, Homo sapiens
ttataaagcaatgagactgatt

SEQ ID NO: 8409 - DNA, 23 bp, Homo sapiens
gtaattttatgtataagctagtc

SEQ ID NO: 8410 - DNA, 24 bp, Homo sapiens
tcagaacaaatgccggttcccaga

SEQ ID NO: 8411 - DNA, 24 bp, Homo sapiens
aattgcacggtatccatctgtaaa

SEQ ID NO: 8412 - DNA, 22 bp, Homo sapiens
gcgacccatacttggtttcaga

SEQ ID NO: 8413 - DNA, 22 bp, Homo sapiens
agtgcctgagggagtaagagcc

SEQ ID NO: 8414 - DNA, 23 bp, Homo sapiens
tctctcggctcctcgcggctcgc

SEQ ID NO: 8415 - DNA, 22 bp, Homo sapiens
aacgcacttccctttagagtgt

SEQ ID NO: 8416 - DNA, 22 bp, Homo sapiens
ctatacggcctcctagctttcc

SEQ ID NO: 8417 - DNA, 22 bp, Homo sapiens
cctgttctccattacttggctc

SEQ ID NO: 8418 - DNA, 25 bp, Homo sapiens
atactgcatcaggaactgattggat

SEQ ID NO: 8419 - DNA, 26 bp, Homo sapiens
atggttgaccagagagcacacgcttt

SEQ ID NO: 8420 - DNA, 25 bp, Homo sapiens
atgcagtccatgggcatatacactt

SEQ ID NO: 8421 - DNA, 27 bp, Homo sapiens
gtgtgtgactggttgaccagaggggca

SEQ ID NO: 8422 - DNA, 24 bp, Homo sapiens
gtaacagtctccagtcacggccac

SEQ ID NO: 8423 - DNA, 23 bp, Homo sapiens
tctacagtgcacgtgtctccagt

SEQ ID NO: 8424 - DNA, 25 bp, Homo sapiens
aaaaactgtaattacttttggacca

SEQ ID NO: 8425 - DNA, 23 bp, Homo sapiens
ccacttggatctgaaggctgccc

SEQ ID NO: 8426 - DNA, 23 bp, Homo sapiens
gtagataaaatattggtacctga

SEQ ID NO: 8427 - DNA, 24 bp, Homo sapiens
tatggctttttattcctatgtgat

SEQ ID NO: 8428 - DNA, 22 bp, Homo sapiens
actctttccctgttgcactact

SEQ ID NO: 8429 - DNA, 24 bp, Homo sapiens
gatcgtgcatccctttagagtgtt

SEQ ID NO: 8430 - DNA, 24 bp, Homo sapiens
cccataaagtagaaagcactacta

SEQ ID NO: 8431 - DNA, 28 bp, Homo sapiens
ctgggtttacgttgggagaacttttacg

SEQ ID NO: 8432 - DNA, 25 bp, Homo sapiens
acccagtgtttagactatctgttca

SEQ ID NO: 8433 - DNA, 22 bp, Homo sapiens
cttagcaggttgtattatcatt

SEQ ID NO: 8434 - DNA, 21 bp, Homo sapiens
cctctgggcccttcctccagc

SEQ ID NO: 8435 - DNA, 28 bp, Homo sapiens
tccatcttccagtacagtgttggatggt

SEQ ID NO: 8436 - DNA, 25 bp, Homo sapiens
atggaatgtaaggaagtgtgtggtt

SEQ ID NO: 8437 - DNA, 23 bp, Homo sapiens
ccagtggggctgctgttatctgg

SEQ ID NO: 8438 - DNA, 27 bp, Homo sapiens
tgtccttcattccaccggagtctgtct

SEQ ID NO: 8439 - DNA, 25 bp, Homo sapiens
tggagtgtgacaatggtgtttgtgt

SEQ ID NO: 8440 - DNA, 23 bp, Homo sapiens
tccattacactaccctgcctctt

SEQ ID NO: 8441 - DNA, 25 bp, Homo sapiens
tggaagactagtgattttgttgttg

SEQ ID NO: 8442 - DNA, 23 bp, Homo sapiens
ccagttaccgcttccgctaccgc

SEQ ID NO: 8443 - DNA, 24 bp, Homo sapiens
ggctgccaattccataggtcacag

SEQ ID NO: 8444 - DNA, 23 bp, Homo sapiens
ttgtttaaccttttgcctgttgg

SEQ ID NO: 8445 - DNA, 23 bp, Homo sapiens
atgtagggctaaaagccatgggc

SEQ ID NO: 8446 - DNA, 24 bp, Homo sapiens
tatggctttttattcctatgtgat

SEQ ID NO: 8447 - DNA, 21 bp, Homo sapiens
gcccctgggcctatcctagaa

SEQ ID NO: 8448 - DNA, 25 bp, Homo sapiens
tcaaacgccattatcacactaaata

SEQ ID NO: 8449 - DNA, 25 bp, Homo sapiens
tcttctctgttttggccatgtgtgt

SEQ ID NO: 8450 - DNA, 24 bp, Homo sapiens
ttattgcttaagaatacgcgtagt

SEQ ID NO: 8451 - DNA, 23 bp, Homo sapiens
tgatatgtttgatattgggttgt

SEQ ID NO: 8452 - DNA, 24 bp, Homo sapiens
ctcactcctctcctcccgtcttct

SEQ ID NO: 8453 - DNA, 23 bp, Homo sapiens
aatcattcacggacaacactttt

SEQ ID NO: 8454 - DNA, 23 bp, Homo sapiens
cctcccacacccaaggcttgcaa

SEQ ID NO: 8455 - DNA, 24 bp, Homo sapiens
tactgtagtatgggcacttccagt

SEQ ID NO: 8456 - DNA, 25 bp, Homo sapiens
aaaaactgtaattacttttggacca

SEQ ID NO: 8457 - DNA, 24 bp, Homo sapiens
acagattcgattctaggggaatat

SEQ ID NO: 8458 - DNA, 26 bp, Homo sapiens
ctgaggtagtagtttgtrcwgttkgt

SEQ ID NO: 8459 - DNA, 27 bp, Homo sapiens
cgtgtatttgacaagctgagttggaca

SEQ ID NO: 8460 - DNA, 24 bp, Homo sapiens
tcgaccggacctcgaccggctcgt

SEQ ID NO: 8461 - DNA, 25 bp, Homo sapiens
ttaatctcagctggcaactgtgaga

SEQ ID NO: 8462 - DNA, 27 bp, Homo sapiens
agctacatctggctactgggtctctga

SEQ ID NO: 8463 - DNA, 26 bp, Homo sapiens
atgattgtagccttttggagtagagt

SEQ ID NO: 8464 - DNA, 22 bp, Homo sapiens
cctggtacaggcctgggggaca

SEQ ID NO: 8465 - DNA, 23 bp, Homo sapiens
tgcctgtctacacttgctgtgca

SEQ ID NO: 8466 - DNA, 25 bp, Homo sapiens
taggcagtgtcattagctgattgta

SEQ ID NO: 8467 - DNA, 24 bp, Homo sapiens
aattgcacggtatccatctgtaaa

SEQ ID NO: 8468 - DNA, 23 bp, Homo sapiens
tgagtaccgccatgtctgttggg

SEQ ID NO: 8469 - DNA, 23 bp, Homo sapiens
actgatttcttttggtgttcaga

SEQ ID NO: 8470 - DNA, 26 bp, Homo sapiens
aagcagcattgtacagggctatsaar

SEQ ID NO: 8471 - DNA, 22 bp, Homo sapiens
agggggaaagttctatagtcct

SEQ ID NO: 8472 - DNA, 23 bp, Homo sapiens
tctctcggctcctcgcggctcgc

SEQ ID NO: 8473 - DNA, 27 bp, Homo sapiens
gaggtgcagtgctgcatctctggtcag

SEQ ID NO: 8474 - DNA, 25 bp, Homo sapiens
ttaggtagtttcatgttgttgggmt

SEQ ID NO: 8475 - DNA, 23 bp, Homo sapiens
ctaatactgtctggtaaaaccgt

SEQ ID NO: 8476 - DNA, 27 bp, Homo sapiens
attatggtttgcctgggactgaggaat

SEQ ID NO: 8477 - DNA, 23 bp, Homo sapiens
tgtctactactggagacactggt

SEQ ID NO: 8478 - DNA, 28 bp, Homo sapiens
ctgggtttacgttgggagaacttttacg

SEQ ID NO: 8479 - DNA, 22 bp, Homo sapiens
caggggctggctttcctctggt

SEQ ID NO: 8480 - DNA, 24 bp, Homo sapiens
tgcctgctggggtggaacctggtc

SEQ ID NO: 8481 - DNA, 23 bp, Homo sapiens
caagctcgtgtctgtgggtccgt

SEQ ID NO: 8482 - DNA, 27 bp, Homo sapiens
gtgtgtgactggttgaccagaggggca

SEQ ID NO: 8483 - DNA, 24 bp, Homo sapiens
attacagttgttcaaccagttact

SEQ ID NO: 8484 - DNA, 25 bp, Homo sapiens
atggaatgtaaagaagtatgtatyt

SEQ ID NO: 8485 - DNA, 21 bp, Homo sapiens
atcacattgccagtgattacc

SEQ ID NO: 8486 - DNA, 23 bp, Homo sapiens
tgagaaccacgtctgctctgagc

SEQ ID NO: 8487 - DNA, 25 bp, Homo sapiens
agctggtgttgtgaatcaggccgwt

SEQ ID NO: 8488 - DNA, 23 bp, Homo sapiens
gcmcawtacacggtcgacctctt

SEQ ID NO: 8489 - DNA, 25 bp, Homo sapiens
ggaagcccttaccccaaaaagyatt

SEQ ID NO: 8490 - DNA, 22 bp, Homo sapiens
agtgcctgagggagtaagagcc

SEQ ID NO: 8491 - DNA, 23 bp, Homo sapiens
tctgtcatttctttaggccaata

SEQ ID NO: 8492 - DNA, 22 bp, Homo sapiens
ctcactgaacaatgaatgcaac

SEQ ID NO: 8493 - DNA, 23 bp, Homo sapiens
cctcctgccctccttgctgtaga

SEQ ID NO: 8494 - DNA, 23 bp, Homo sapiens
ttaagacttgcagtgatgtttaa

SEQ ID NO: 8495 - DNA, 24 bp, Homo sapiens
ctgaggagatcgtcgaggttggcc

SEQ ID NO: 8496 - DNA, 26 bp, Homo sapiens
aatccttggaacctaggtgtgagtgc

SEQ ID NO: 8497 - DNA, 24 bp, Homo sapiens
ttgcatagtcacaaaagtgatcat

SEQ ID NO: 8498 - DNA, 26 bp, Homo sapiens
aggggtgctatctgtgattgagggac

SEQ ID NO: 8499 - DNA, 26 bp, Homo sapiens
gccatagcccggtcgctggtacatga

SEQ ID NO: 8500 - DNA, 28 bp, Homo sapiens
catgatactgtaaacgctttctgatgta

SEQ ID NO: 8501 - DNA, 25 bp, Homo sapiens
ttttgttcgttcggctcgcgtgagg

SEQ ID NO: 8502 - DNA, 21 bp, Homo sapiens
cagtggccagagccctgcagt

SEQ ID NO: 8503 - DNA, 24 bp, Homo sapiens
tgttcctctgtctcccagactctg

SEQ ID NO: 8504 - DNA, 22 bp, Homo sapiens
ccagtattaactgtgctgctga

SEQ ID NO: 8505 - DNA, 26 bp, Homo sapiens
cataaagctagataaccgaaagtara

SEQ ID NO: 8506 - DNA, 24 bp, Homo sapiens
ctgccctggcccgagggaccgact

SEQ ID NO: 8507 - DNA, 24 bp, Homo sapiens
ggattcctggaaatactgttcttg

SEQ ID NO: 8508 - DNA, 23 bp, Homo sapiens
tgagcgcctcgacgacagagccg

SEQ ID NO: 8509 - DNA, 24 bp, Homo sapiens
gtttttcattattgctcctgacct

SEQ ID NO: 8510 - DNA, 23 bp, Homo sapiens
gtcatttttgtgatgttgcagct

SEQ ID NO: 8511 - DNA, 24 bp, Homo sapiens
gcagtgcaatgttaaaagggcatt

SEQ ID NO: 8512 - DNA, 22 bp, Homo sapiens
atgctgacatatttactagagg

SEQ ID NO: 8513 - DNA, 24 bp, Homo sapiens
catcagggcttgtggaatgggaag

SEQ ID NO: 8514 - DNA, 26 bp, Homo sapiens
tgattaatatcggacaaccattgttt

SEQ ID NO: 8515 - DNA, 21 bp, Homo sapiens
ctatacaatctattgccttcc

SEQ ID NO: 8516 - DNA, 22 bp, Homo sapiens
ctcctacatattagcattaaca

SEQ ID NO: 8517 - DNA, 25 bp, Homo sapiens
ttttcctatgcatatacttctttga

SEQ ID NO: 8518 - DNA, 23 bp, Homo sapiens
aatcatacacggttgacctattt

SEQ ID NO: 8519 - DNA, 23 bp, Homo sapiens
ctttcagtcagatgtttgctgct

SEQ ID NO: 8520 - DNA, 30 bp, Homo sapiens; identical to SEQ ID NO: 8045

SEQ ID NO: 8521 - DNA, 25 bp, Homo sapiens
ttgcagctgcctgggagtgacttca

SEQ ID NO: 8522 - DNA, 24 bp, Homo sapiens
ggatatcatcatatactgtaagtt

SEQ ID NO: 8523 - DNA, 24 bp, Homo sapiens
gagcctctaagaagttgactgaag

SEQ ID NO: 8524 - DNA, 23 bp, Homo sapiens
tcagtaacaaagattcatccttg

SEQ ID NO: 8525 - DNA, 26 bp, Homo sapiens
tgaaaatgatgagtagtgactgatga

SEQ ID NO: 8526 - DNA, 22 bp, Homo sapiens
ctggggttctgagacagacagt

SEQ ID NO: 8527 - DNA, 23 bp, Homo sapiens
tactgcaatgtaagcacttctta

SEQ ID NO: 8528 - DNA, 25 bp, Homo sapiens
tgtctcccaacccttgtaccagtgc

SEQ ID NO: 8529 - DNA, 23 bp, Homo sapiens
ttgtacatggtaggctttcattc

SEQ ID NO: 8530 - DNA, 23 bp, Homo sapiens
tgcggggctagggctaacagcag

SEQ ID NO: 8531 - DNA, 23 bp, Homo sapiens
gtaattttatgtataagctagtc

SEQ ID NO: 8532 - DNA, 23 bp, Homo sapiens
gaacatcacagcaagtctgtgct

SEQ ID NO: 8533 - DNA, 23 bp, Homo sapiens
aaggcagggcccccgctccccgg

SEQ ID NO: 8534 - DNA, 24 bp, Homo sapiens
caatcactaactccactgccatca

SEQ ID NO: 8535 - DNA, 23 bp, Homo sapiens
aatcacacaaaggcaacttttgt

SEQ ID NO: 8536 - DNA, 23 bp, Homo sapiens
ataatacatggttaacctctttt

SEQ ID NO: 8537 - DNA, 23 bp, Homo sapiens
gtagataaaatattggtacctga

SEQ ID NO: 8538 - DNA, 23 bp, Homo sapiens
attaggccgcagatctgggtgaa

SEQ ID NO: 8539 - DNA, 22 bp, Homo sapiens
ctcgtgggctctggccacggcc

SEQ ID NO: 8540 - DNA, 24 bp, Homo sapiens
gtgcctactgagctgaaacacagt

SEQ ID NO: 8541 - DNA, 23 bp, Homo sapiens
gaaattattgtacatcggatgag

SEQ ID NO: 8542 - DNA, 24 bp, Homo sapiens
tgatatgtttgatatattaggttg

SEQ ID NO: 8543 - DNA, 25 bp, Homo sapiens
tctcacacagaaatcgcacccgtca

SEQ ID NO: 8544 - DNA, 25 bp, Homo sapiens
cacaaatctccggaccacttagtct

SEQ ID NO: 8545 - DNA, 22 bp, Homo sapiens
cagcagcacactgtggtttgta

SEQ ID NO: 8546 - DNA, 22 bp, Homo sapiens
cctgttctccattacttggctc

SEQ ID NO: 8547 - DNA, 24 bp, Homo sapiens
gacctctgaaattcagttcttcag

SEQ ID NO: 8548 - DNA, 25 bp, Homo sapiens
tttgtaaggcacccttctgagtaga

SEQ ID NO: 8549 - DNA, 24 bp, Homo sapiens
ctcttgagggaagcactttctgtt

SEQ ID NO: 8550 - DNA, 26 bp, Homo sapiens
gagtcatacacggctctcctctcttt

SEQ ID NO: 8551 - DNA, 25 bp, Homo sapiens
atactgcatcaggaactgattggat

SEQ ID NO: 8552 - DNA, 23 bp, Homo sapiens
catcttactgggcagcattggat

SEQ ID NO: 8553 - DNA, 23 bp, Homo sapiens
aacacacctattcaaggattcaa

SEQ ID NO: 8554 - DNA, 25 bp, Homo sapiens
taggtagtttcctgttgttgggatc

SEQ ID NO: 8555 - DNA, 25 bp, Homo sapiens
ctcctgactccaggtcctgtgtgtt

SEQ ID NO: 8556 - DNA, 22 bp, Homo sapiens
ttacccagtctccggtgcagcc

SEQ ID NO: 8557 - DNA, 25 bp, Homo sapiens
ttgtgaaatgtttaggaccactaga

SEQ ID NO: 8558 - DNA, 23 bp, Homo sapiens
atagtagaccgtatagcgtacgc

SEQ ID NO: 8559 - DNA, 25 bp, Homo sapiens
cggggccgtagcactgtctgagagg

SEQ ID NO: 8560 - DNA, 22 bp, Homo sapiens
taggttatccgtgttgccttcg

SEQ ID NO: 8561 - DNA, 23 bp, Homo sapiens
aatataacacagatggcctgttt

SEQ ID NO: 8562 - DNA, 24 bp, Homo sapiens
gtaacagtctccagtcacggccac

SEQ ID NO: 8563 - DNA, 24 bp, Homo sapiens
actgctgagctagcacttcccgag

SEQ ID NO: 8564 - DNA, 24 bp, Homo sapiens
taaggtgcatctagtgcagwtagt

SEQ ID NO: 8565 - DNA, 23 bp, Homo sapiens
atatacaagggcaagctctctgt

SEQ ID NO: 8566 - DNA, 25 bp, Homo sapiens
actgtgcgtgtgacagcggctgatc

SEQ ID NO: 8567 - DNA, 24 bp, Homo sapiens
ctttttgcggtctgggcttgctgt

SEQ ID NO: 8568 - DNA, 24 bp, Homo sapiens
aatcactaaccacacggccaggta

SEQ ID NO: 8569 - DNA, 25 bp, Homo sapiens
aggaagccctggaggggctggaggt

SEQ ID NO: 8570 - DNA, 27 bp, Homo sapiens
agtcccccaggtgtgattctgatttgc

SEQ ID NO: 8571 - DNA, 25 bp, Homo sapiens
ctaatactgccgggtaatgatggag

SEQ ID NO: 8572 - DNA, 25 bp, Homo sapiens
tacccattgcatatcggagttgtga

SEQ ID NO: 8573 - DNA, 25 bp, Homo sapiens
tagtgcaatattgcttatagggttt

SEQ ID NO: 8574 - DNA, 22 bp, Homo sapiens
aaaatggttccctttagagtgt

SEQ ID NO: 8575 - DNA, 24 bp, Homo sapiens
tcgaggactggtggaagggccttt

SEQ ID NO: 8576 - DNA, 22 bp, Homo sapiens
actctttccctgttgcactact

SEQ ID NO: 8577 - DNA, 25 bp, Homo sapiens
aggcctattcttgattacttgtttc

SEQ ID NO: 8578 - DNA, 21 bp, Homo sapiens
cctctgggcccttcctccagc

SEQ ID NO: 8579 - DNA, 32 bp, Homo sapiens; identical to SEQ ID NO: 7894

SEQ ID NO: 8580 - DNA, 27 bp, Homo sapiens
wggcagtgtattgttagctggytgctt

SEQ ID NO: 8581 - DNA, 23 bp, Homo sapiens
tactgcagacgtggcaatcatgt

SEQ ID NO: 8582 - DNA, 22 bp, Homo sapiens
cgaatcattatttgctgctcta

SEQ ID NO: 8583 - DNA, 23 bp, Homo sapiens
caagctcgcttctatgggtctgt

SEQ ID NO: 8584 - DNA, 24 bp, Homo sapiens
ggtgcctactgagctgatatcagt

SEQ ID NO: 8585 - DNA, 23 bp, Homo sapiens
gtataggcctttagatcatctga

SEQ ID NO: 8586 - DNA, 27 bp, Homo sapiens
catcttaccggacagtgctggatttcc

SEQ ID NO: 8587 - DNA, 25 bp, Homo sapiens
ctaatactgcctggtaatgatgacg

SEQ ID NO: 8588 - DNA, 21 bp, Homo sapiens
gtgtgcggaaatgcttctgct

SEQ ID NO: 8589 - DNA, 25 bp, Homo sapiens
atcatacaaggacaatttctttttg

SEQ ID NO: 8590 - DNA, 24 bp, Homo sapiens
gtgaggactcgggaggtggagggt

SEQ ID NO: 8591 - DNA, 25 bp, Homo sapiens
ttgcaggtcgtcttgcagggcttct

SEQ ID NO: 8592 - DNA, 22 bp, Homo sapiens
tccgagcctgggtctccctctt

SEQ ID NO: 8593 - DNA, 22 bp, Homo sapiens
ccacctcccctgcaaacgtcca

SEQ ID NO: 8594 - DNA, 24 bp, Homo sapiens
catctcactgtagcctcgaacccc

SEQ ID NO: 8595 - DNA, 22 bp, Homo sapiens
tttaggataagcttgacttttg

What is claimed is:

1. A method of treating a cancer selected from the group consisting of colon adenocarcinoma (COAD), stomach adenocarcinoma (STAD), rectum adenocarcinoma (READ), esophageal carcinoma (ESCA), pancreatic adenocarcinoma (PAAD), and ovarian carcinoma (OV), said method comprising:
    isolating isomiRs or miRNAs from a sample obtained from the subject;
    characterizing the isomiRs or miRNAs and their presence or absence in the sample to identify a signature;
    evaluating the signature with a multi-cancer classifier, wherein the multi-cancer classifier has been trained using tumor samples from two or more cancers as examples and using qualitative, binarized profiles based on the presence or absence of expression of the isomiRs or miRNAs, wherein the "presence" of expression of the isomiR or miRNA means the isomiR or miRNA is among the top 20% most abundant isomiR or miRNA, and wherein the "absence" of expression of the isomiR or miRNA means the isomiR or miRNA is not among the top 20% most abundant isomiRs or miRNAs; and
    determining whether the signature is indicative of any one cancer of COAD, STAD, READ, ESCA, PAAD, or OV, among the two or more cancers; and
    administering to the subject a specific chemotherapy specifically targeting said any one cancer of COAD, STAD, READ, ESCA, PAAD, or OV being indicated.

2. The method of claim 1, wherein the sample is isolated from one or more cells, from tissue or from body fluid obtained from the subject.

3. The method of claim 2, wherein the sample is contained in a formalin-treated paraffin-embedded block.

4. The method of claim 2, wherein the sample is contained in an optimal cutting compound block.

5. The method of claim 2, wherein the body fluid is selected from the group consisting of amniotic fluid, aqueous humour and vitreous humour, bile, blood serum, breast milk, cerebrospinal fluid, cerumen, chyle, chyme, endolymph and perilymph, exudates, feces, female ejaculate, gastric acid, gastric juice, lymph, mucus, pericardial fluid, peritoneal fluid, pleural fluid, pus, rheum, saliva, sebum, serous fluid, semen, smegma, sputum, synovial fluid, sweat, tears, urine, vaginal secretion, and vomit.

6. The method of claim 2, wherein the sample is selected from the group consisting of a peripheral blood cell, a tumor cell, a circulating tumor cell, an exosome.

7. The method of claim 1, wherein the isomiRs are isolated by a method selected from the group consisting of size selection, amplification and sequencing.

8. The method of claim 1, wherein the miRNAs are isolated by a method selected from the group consisting of size selection, amplification and sequencing.

9. The method of claim 1, wherein isomiRs with a length in the range of 15 nucleotides to 25 nucleotides are isolated.

10. The method of claim 1, wherein miRNAs with a length in the range of 15 nucleotides to 25 nucleotides are isolated.

11. The method of claim 1, wherein the signature is obtained through sequence-specific methods that preserve the nucleotide sequence identity of at least one terminus of the isomiR.

12. The method of claim 1, wherein the signature is obtained through sequence-specific methods that preserve the nucleotide sequence identity of both termini of the isomiR.

13. The method of claim 1, wherein the signature is obtained by hybridization to an oligonucleotide panel of oligonucleotide probes.

14. The method of claim 13, wherein the oligonucleotide panel comprises at least one or more polynucleotide probes that selectively hybridize to at least one isomiR.

15. The method of claim 13, wherein the oligonucleotide panel comprises at least one or more polynucleotide probes that selectively hybridize to at least one miRNA.

16. The method of claim 1, wherein the abundance of the isolated isomiRs is not taken into account by subsequent analyses.

17. The method of claim 1, wherein the abundance of the isolated miRNAs is not taken into account by subsequent analyses.

18. The method of claim 1 wherein the tumor samples used to train the classifier are from two or more cancers selected from the group consisting of acute myeloid leukemia, adrenocortical carcinoma, bladder urothelial carcinoma, brain lower grade glioma, breast invasive carcinoma, cervical squamous cell carcinoma and endocervical adenocarcinoma, cholangiocarcinoma, colon adenocarcinoma, esophageal carcinoma, glioblastoma multiforme, head and neck squamous cell carcinoma, kidney chromophobe, kidney renal clear cell carcinoma, kidney renal papillary cell carcinoma, liver hepatocellular carcinoma, lung adenocarcinoma, lung squamous cell carcinoma, lymphoid neoplasm diffuse large b-cell lymphoma, mesothelioma, ovarian serous cystadenocarcinoma, pancreatic adenocarcinoma, pheochromocytoma and paraganglioma, prostate adenocarcinoma, rectum adenocarcinoma, sarcoma, skin cutaneous melanoma, stomach adenocarcinoma, testicular germ cell tumors, thymoma, thyroid carcinoma, uterine carcinosarcoma, uterine corpus endometrial carcinoma, and uveal melanoma.

19. The method of claim 18 wherein the classifier was trained specifically using as positive examples samples from one or more of stomach adenocarcinoma, colon adenocarcinoma, esophageal carcinoma, pancreatic adenocarcinoma, rectum adenocarcinoma, and as negative examples disease-free samples or samples from non-cancer diseases or samples from cancers other than stomach adenocarcinoma, colon adenocarcinoma, esophageal carcinoma, pancreatic adenocarcinoma, and rectum adenocarcinoma.

20. The method of claim 19, wherein the classifier uses features that are based on knowledge of the presence or absence of expression of miRNA arms.

21. The method of claim 20, wherein the total number of miRNA arms evaluated is between 1 and 161.

22. The method of claim 21, wherein the miRNAs to be evaluated are the ones with identifiers SEQ ID NOs 8,435 through 8,595 inclusive.

23. The method of claim 20, wherein the total number of miRNA arms evaluated is between 1 and 80.

24. The method of claim 23, wherein the miRNAs to be evaluated are the ones with identifiers SEQ ID NOs 8,435 through 8,514 inclusive.

25. The method of claim 20, wherein the total number of miRNA arms evaluated is between 1 and 40.

26. The method of claim 25, wherein the miRNAs to be evaluated are the ones with identifiers SEQ ID NOs 8,435 through 8,474 inclusive.

27. The method of claim 20, wherein the total number of miRNA arms evaluated is between 1 and 24.

28. The method of claim 27, wherein the miRNAs to be evaluated are the ones with identifiers SEQ ID NOs 8,435 through 8,458 inclusive.

29. The method of claim 20, wherein the total number of miRNA arms evaluated is between 1 and 16.

30. The method of claim 29, wherein the miRNAs to be evaluated are the ones with identifiers SEQ ID NOs 8,435 through 8,450 inclusive.

31. The method of claim 19 wherein the classifier was trained with positive examples that correspond solely to stomach adenocarcinoma.

32. The method of claim 31, wherein the classifier uses features that are based on knowledge of the presence or absence of expression of miRNA arms.

33. The method of claim 32 wherein the total number of miRNA arms evaluated is between 1 and 161.

34. The method of claim 33, wherein the miRNAs to be evaluated are the ones with identifiers SEQ ID NOs 8,274 through 8,434 inclusive.

35. The method of claim 32 wherein the total number of miRNA arms evaluated is between 1 and 80.

36. The method of claim 35, wherein the miRNAs to be evaluated are the ones with identifiers SEQ ID NOs 8,274 through 8,353 inclusive.

37. The method of claim 32 wherein the total number of miRNA arms evaluated is between 1 and 40.

38. The method of claim 37, wherein the miRNAs to be evaluated are the ones with identifiers SEQ ID NOs 8,274 through 8,313 inclusive.

39. The method of claim 32 wherein the total number of miRNA arms evaluated is between 1 and 24.

40. The method of claim 39, wherein the miRNAs to be evaluated are the ones with identifiers SEQ ID NOs 8,274 through 8,297 inclusive.

41. The method of claim 32 wherein the total number of miRNA arms evaluated is between 1 and 16.

42. The method of claim 41, wherein the miRNAs to be evaluated are the ones with identifiers SEQ ID NOs 8,274 through 8,289 inclusive.

43. The method of claim 1, wherein the total number of isomiRs evaluated is between 1 and 7,466.

44. The method of claim 43, wherein the isomiRs to be evaluated are the ones with identifiers SEQ ID NOs 1 through 7,466 inclusive.

45. The method of claim 1, wherein the total number of isomiRs evaluated is between 1 and 2,588.

46. The method of claim 45, wherein the isomiRs to be evaluated are the ones with identifiers SEQ ID NOs 1 through 2,588 inclusive.

47. The method of claim 1, wherein the total number of isomiRs evaluated is between 1 and 1,883.

48. The method of claim 47, wherein the isomiRs to be evaluated are the ones with identifiers SEQ ID NOs 1 through 1,883 inclusive.

49. The method of claim 1, wherein the total number of isomiRs evaluated is between 1 and 1,147.

50. The method of claim 49, wherein the isomiRs to be evaluated are the ones with identifiers SEQ ID NOs 1 through 1,147 inclusive.

51. The method of claim 1, wherein the total number of isomiRs evaluated is between 1 and 456.

52. The method of claim 51, wherein the isomiRs to be evaluated are the ones with identifiers SEQ ID NOs 1 through 456 inclusive.

53. The method of claim 1, wherein the total number of miRNA arms evaluated is between 1 and 807.

54. The method of claim 53, wherein the miRNAs to be evaluated are the ones with identifiers SEQ ID NOs 7,467 through 8,273 inclusive.

55. The method of claim 1, wherein the total number of miRNA arms evaluated is between 1 and 285.

56. The method of claim 55, wherein the isomiRs to be evaluated are the ones with identifiers SEQ ID NOs 7,467 through 7,751 inclusive.

57. The method of claim 1, wherein the total number of miRNA arms evaluated is between 1 and 198.

58. The method of claim 57, wherein the isomiRs to be evaluated are the ones with identifiers SEQ ID NOs 7,467 through 7,664 inclusive.

59. The method of claim 1, wherein the total number of miRNA arms evaluated is between 1 and 115.

60. The method of claim 59, wherein the isomiRs to be evaluated are the ones with identifiers SEQ ID NOs 7,467 through 7,581 inclusive.

61. The method of claim 1, wherein the total number of miRNA arms evaluated is between 1 and 47.

62. The method of claim 61, wherein the isomiRs to be evaluated are the ones with identifiers SEQ ID NOs 7,467 through 7,513 inclusive.

* * * * *